US011384122B2

(12) United States Patent
Langedijk et al.

(10) Patent No.: US 11,384,122 B2
(45) Date of Patent: Jul. 12, 2022

(54) COMPOSITIONS AND METHODS FOR PREVENTING AND TREATING CORONAVIRUS INFECTION—SARS-COV-2 VACCINES

(71) Applicants: Janssen Pharmaceuticals, Inc., Titusville, NJ (US); Beth Israel Deaconess Medical Center, Inc., Boston, MA (US)

(72) Inventors: Johannes Petrus Maria Langedijk, Amsterdam (NL); Lucy Rutten, Rijnsburg (NL); Mark Johannes Gerardus Bakkers, Haarsteeg (NL); Rinke Bos, Oegstgeest (NL); Frank Wegmann, Leiden (NL); David Adrianus Theodorus Maria Zuijdgeest, The Hague (NL); Dan H. Barouch, Newton, MA (US); An Vandebosch, Herentals (BE); Mathieu Claude Michel le Gars, Antwerp (BE); Jerald C. Sadoff, Washington, DC (US)

(73) Assignees: Janssen Pharmaceuticals, Inc., Titusville, NJ (US); Beth Israel Deaconess Medical Center, Inc., Boston, MA (US)

(*) Notice: Subject to any disclaimer, the term of this patent is extended or adjusted under 35 U.S.C. 154(b) by 0 days.

(21) Appl. No.: 17/387,105

(22) Filed: Jul. 28, 2021

(65) Prior Publication Data
US 2021/0388032 A1  Dec. 16, 2021

Related U.S. Application Data

(63) Continuation of application No. 17/163,357, filed on Jan. 30, 2021.
(Continued)

(30) Foreign Application Priority Data

Nov. 28, 2020 (CA) .................................. CA3101131

(51) Int. Cl.
*A61K 39/00* (2006.01)
*C07K 14/005* (2006.01)
*A61K 35/12* (2015.01)
*A61K 39/08* (2006.01)
*A61K 39/12* (2006.01)
*A61P 31/14* (2006.01)
*C12N 7/00* (2006.01)
(Continued)

(52) U.S. Cl.
CPC .......... *C07K 14/005* (2013.01); *A61K 39/215* (2013.01); *A61P 31/14* (2018.01); *C12N 7/00* (2013.01); *C12N 15/86* (2013.01); *A61K 2039/5256* (2013.01); *A61K 2039/53* (2013.01); *A61K 2039/545* (2013.01); *C12N 2750/14143* (2013.01); *C12N 2750/14151* (2013.01); *C12N 2750/14171* (2013.01); *C12N 2770/20022* (2013.01); *C12N 2770/20034* (2013.01); *C12N 2770/20071* (2013.01)

(58) Field of Classification Search
CPC .................. A61P 35/00; C07K 14/005; C12N 2770/20022; A61K 2035/122
See application file for complete search history.

(56) References Cited

U.S. PATENT DOCUMENTS 4,603,112 A    7/1986 Paoletti
5,057,540 A   10/1991 Kensil
(Continued)

FOREIGN PATENT DOCUMENTS

EP    0853660 A1    7/1998
WO    9003184 A1    4/1990
(Continued)

OTHER PUBLICATIONS

Abbink, P., et al., "Comparative seroprevalence and immunogenicity of six rare serotype recombinant adenovirus vaccine vectors from subgroups B and D", Journal of Virology, The American Society for Microbiology, vol. 81, No. 9, pp. 4654-4663, (2007).
(Continued)

*Primary Examiner* — Barry A Chestnut
(74) *Attorney, Agent, or Firm* — Ice Miller LLP

(57) ABSTRACT

The invention relates to immunogenic compositions and vaccines containing a coronavirus (e.g., Wuhan coronavirus (2019-nCoV; also referred to as SARS-CoV-2)) protein or a polynucleotide encoding a coronavirus (e.g., Wuhan coronavirus (2019-nCoV; SARS-CoV-2)) protein and uses thereof. The invention also provides methods of treating and/or preventing a coronavirus (e.g., Wuhan coronavirus (2019-nCoV; SARS-CoV-2)) infection by administering an immunogenic composition or vaccine to a subject (e.g., a human). The invention also provides methods of detecting and/or monitoring a protective anti-coronavirus (e.g., Wuhan coronavirus (2019-nCoV; SARS-CoV-2)) antibody response (e.g., anti-coronavirus antibody response, e.g., anti-2019-nCoV antibody response, e.g., anti-Spike antibody response, e.g., anti-Spike neutralizing antibody response). The present invention relates to isolated nucleic and/or recombinant nucleic acid encoding a coronavirus S protein, in particular a SARS-CoV-2 S protein, and to the coronavirus S proteins, as well as to the use of the nucleic acids and/or proteins thereof in vaccines.

30 Claims, 233 Drawing Sheets
(217 of 233 Drawing Sheet(s) Filed in Color)
Specification includes a Sequence Listing.

Related U.S. Application Data

(60) Provisional application No. 63/142,977, filed on Jan. 28, 2021, provisional application No. 63/141,913, filed on Jan. 26, 2021, provisional application No. 63/135,182, filed on Jan. 8, 2021, provisional application No. 63/133,969, filed on Jan. 5, 2021, provisional application No. 63/121,482, filed on Dec. 4, 2020, provisional application No. 63/112,900, filed on Nov. 12, 2020, provisional application No. 63/198,306, filed on Oct. 9, 2020, provisional application No. 63/198,089, filed on Sep. 28, 2020, provisional application No. 62/706,958, filed on Sep. 21, 2020, provisional application No. 62/706,937, filed on Sep. 18, 2020, provisional application No. 62/706,676, filed on Sep. 2, 2020, provisional application No. 63/066,147, filed on Aug. 14, 2020, provisional application No. 62/706,366, filed on Aug. 12, 2020, provisional application No. 63/043,090, filed on Jun. 23, 2020, provisional application No. 62/705,308, filed on Jun. 21, 2020, provisional application No. 62/705,187, filed on Jun. 15, 2020, provisional application No. 63/025,782, filed on May 15, 2020, provisional application No. 63/014,467, filed on Apr. 23, 2020, provisional application No. 62/994,630, filed on Mar. 25, 2020, provisional application No. 62/969,008, filed on Jan. 31, 2020.

(51) Int. Cl.
 *C12N 15/86* (2006.01)
 *A61K 39/215* (2006.01)

(56) References Cited

U.S. PATENT DOCUMENTS

| | | | |
|---|---|---|---|
| 5,639,649 A | 6/1997 | Almond | |
| 5,643,576 A | 7/1997 | Johnston | |
| 5,762,938 A | 6/1998 | Paoletti | |
| 5,801,030 A | 9/1998 | McVey | |
| 6,083,716 A | 7/2000 | Wilson | |
| 6,225,289 B1 | 5/2001 | Kovesdi | |
| 7,179,903 B2 | 2/2007 | McArthur | |
| 10,953,089 B1 | 3/2021 | Smith et al. | |
| 2005/0095582 A1 | 5/2005 | Gillim-Ross et al. | |
| 2005/0112554 A1 | 5/2005 | Zhao et al. | |
| 2006/0121580 A1 | 6/2006 | Ter Meulen et al. | |
| 2007/0270361 A1 | 11/2007 | Lu et al. | |
| 2012/0076812 A1 | 3/2012 | Barouch | |
| 2020/0030432 A1 | 1/2020 | Ciaramella et al. | |
| 2020/0407402 A1 | 12/2020 | He et al. | |

FOREIGN PATENT DOCUMENTS

| | | | |
|---|---|---|---|
| WO | 9014837 A1 | 12/1990 | |
| WO | 9611711 A1 | 4/1996 | |
| WO | 9912568 A1 | 3/1999 | |
| WO | 9941416 A2 | 8/1999 | |
| WO | 0029024 A1 | 5/2000 | |
| WO | 0136620 A2 | 5/2001 | |
| WO | 0166137 A1 | 9/2001 | |
| WO | 2003049763 | 6/2003 | |
| WO | 2003061708 | 7/2003 | |
| WO | 2003078592 A2 | 9/2003 | |
| WO | 2004004762 A1 | 1/2004 | |
| WO | 2005002620 A1 | 1/2005 | |
| WO | 2005012360 A2 | 2/2005 | |
| WO | 2005071093 A2 | 8/2005 | |
| WO | 2006040330 A2 | 4/2006 | |
| WO | 2006060641 A2 | 6/2006 | |
| WO | 2007024941 A2 | 3/2007 | |
| WO | 2007104792 A2 | 9/2007 | |
| WO | 2007110409 A1 | 10/2007 | |
| WO | 2010060719 A1 | 6/2010 | |
| WO | 2010085984 A1 | 8/2010 | |
| WO | 2010086189 A2 | 8/2010 | |
| WO | 2011098592 A1 | 8/2011 | |
| WO | 2012082918 A1 | 6/2012 | |
| WO | 2012172277 A1 | 12/2012 | |
| WO | 2018081318 A1 | 5/2018 | |
| WO | 2018146205 A1 | 8/2018 | |
| WO | 2018215766 A1 | 11/2018 | |
| WO | 2019086456 A1 | 5/2019 | |
| WO | 2019086461 A1 | 5/2019 | |
| WO | 2019086466 A1 | 5/2019 | |
| WO | 2021155323 A1 | 8/2021 | |

OTHER PUBLICATIONS

Abbink, P., et al., "Protective efficacy of multiple vaccine platforms against Zika virus challenge in rhesus monkeys", Science, US, vol. 353, No. 6304, pp. 1129-1132, (2016).

Abbink, P., et al., "Durability and correlates of vaccine protection against Zika virus in rhesus monkeys", Science Translational Medicine, US, vol. 9, No. 420, p. 4163 (2017).

Abbink, P., et al., "Lack of Therapeutic Efficacy of an Anti-a4b7 Antibody in SIVmac251-Infected Rhesus Macaques," Science 365, pp. 1029-1033 (2019).

Ackerman, M., et al., "A robust, high-throughput assay to determine the phagocytic activity of clinical antibody samples," J Immunol Methods 366, 8-19, doi:10.1016/j.jim.2010.12.016 (2011).

Algaissi, A., et al., "Evaluation of MERS-CoV Neutralizing Antibodies in Sera Using Live Virus Microneutralization Assay," Methods Mol Biol, pp. 107-116 (2020). doi:10.1007/978-1-0716-0211-9_9).

Alharbi, H., et al., "ChAd0x1 and MVA based vaccine candidates against MERS-CoV elicit neutralising antibodies and cellular immune responses in mice," Vaccine 35, pp. 3780-3788, doi: 10.1016/j.vaccine.2017.05.032 (2017).

Altfeld, M., et al., "HIV-1 superinfection despite broad CD8+ T-cell responses containing replication of the primary virus," Nature 420, pp. 434-439 (2002).

Baden, L., et al., "First-in-Human Evaluation of the Safety and Immunogenicity of a Recombinant Adenovirus Serotype 26 HIV-1 Env Vaccine (IPCAVD 001)," The Journal of Infectious Diseases, vol. 207, pp. 240-247 (2013).

Bangari, D., et al., "Development of nonhuman adenoviruses as vaccine vectors," Vaccine, vol. 24, No. 7, pp. 849-862 (2006).

Bao, L., et al., "The pathogenicity of SARS-CoV-2 in hACE2 transgenic mice," Nature, vol. 583, doi:10.1038/S41586-020-2312-y, pp. 830-833 (2020).

Barouch, D., et al., "Protective Efficacy of Adenovirus/Protein Vaccines Against SIV Challenges in Rhesus Monkeys", Science, vol. 349, No. 6245, pp. 320-324 (Jul. 2015).

Barouch, D., et al., "Evaluation of a mosaic HIV-1 vaccine in a multicentre, randomised, double-blind, placebo-controlled, phase 1/2a clinical trial (APPROACH) and in rhesus monkeys (NHP 13-19)", Lancet, Amsterdam, NL, vol. 392, No. 10143, doi:10.1016/S0140-6736(18)31364-3, ISSN 0140-6736, pp. 232-243, XP055528502 (2018).

Blanco-Melo, D., et al., "Imbalanced Host Response to SARS-CoV-2 Drives Development of COVID-19," Cell 181, e1039, doi:10.1016/j.cell.2020.04.026, pp. 1036-1045 (2020).

Bos, R., et al., "Ad26 vector-based COVID-19 vaccine encoding a prefusion-stabilized SARS-CoV-2 Spike immunogen induces potent humoral and cellular immune responses," Vaccines, vol. 5, No. 91, https://doi.org/10.1038/s41541-020-00243-x, pp. 1-11 (2020).

Bowyer, G., et al., "Activation-induced Markers Detect Vaccine-Specific CD4+ T Cell Responses Not Measured by Assays Conventionally Used in Clinical Trials," Vaccines, vol. 6, No. 50, pp. 1-19, doi:10.3390/vaccines6030050 (2018).

Brown, E., et al., "High-throughput, multiplexed IgG subclassing of antigen-specific antibodies from clinical samples," J Immunol Methods, vol. 386(1-2), pp. 117-123, doi:10.1016/j.jim.2012.09.007 (2012).

(56) References Cited

OTHER PUBLICATIONS

Brown, E., et al., "Multiplexed Fc array for evaluation of antigen-specific antibody effector profiles," Journal of Immunological Methods, vol. 443, pp. 33-44, doi:10.1016/j.jim.2017.01.010 (2017).
Callow, K., et al., "The time course of the immune response to experimental coronavirus infection of man," Epidemiol. Infect., vol. 105, pp. 435-446 (1990).
Chan, J., et al., "Simulation of the clinical and pathological manifestations of Coronavirus Disease 2019 (COVID-19) in golden Syrian hamster model: implications for disease pathogenesis and transmissibility," Oxford University Press for the Infectious Diseases Society of America, Clin Infect Dis, pp. 1-50, doi:10.1093/cid/ciaa325 (2020).
Chan, J., et al., "A familial cluster of pneumonia associated with the 2019 novel coronavirus indicating person-to-person transmission: a study of a family cluster," Lancet, vol. 395, pp. 514-523, doi:10.1016/S0140-6736(20)30154-9 (2020).
Chen, B. et al., "A Chimeric Protein of Simian Immunodeficiency Virus Envelope Glycoprotein gp140 and *Escherichia coli* Asparatate Transcarbamoylase," J. Virol, vol. 78, No. 9, pp. 4508-4516 (2004).
Chen, N., et al., "Epidemiological and clinical characteristics of 99 cases of 2019 novel coronavirus pneumonia in Wuhan, China: a descriptive study," Lancet 395, pp. 507-513, doi:10.1016/S0140-6736(20)30211-7 (2020).
Chandrashekar, A., et al., "SARS-CoV-2 infection protects against rechallenge in rhesus macaques," Science 369, pp. 812-817 (2020).
Chung, A., et al., "Dissecting Polyclonal Vaccine-Induced Humoral Immunity against HIV Using Systems Serology," Cell 163, pp. 988-998, doi:10.1016/j.cell.2015.10.027 (2015).
Cohen, C., et al., "Chimpanzee Adenovirus CV-68 Adapted as a Gene Delivery Vector Interacts with the Coxsackievirus and Adenovirus Receptor", J. Gen. Virol., vol. 83, pp. 151-155 (2002).
Corbett, K. et al., "Evaluation of the mRNA-1273 Vaccine against SARS-CoV-2 in Nonhuman Primates,"The New England Journal of Medicine, vol. 383, No. 16, pp. 1544-1555 (2020).
Cox, F., et al., "Adenoviral vector type 26 encoding Zika virus (ZIKV) M-Env antigen induces humoral and cellular immune responses and protects mice and nonhuman primates against ZIKV challenge," PLoS ONE , vol. 13, No. 8, e0202820, pp. 1-19, doi:10.1371/journal.pone.0202820 (2018).
Deleage, C., et al., "Impact of early cART in the gut during acute HIV infection," JCI insight 1, pp. 1-18 (2016).
Deleage, C., et al., "Defining HIV and SIV Reservoirs in Lymphoid Tissues," Pathogens and Immunity, vol. 1, No. 1, pp. 68-106 (2016).
Doremalen, N., et al., "ChAdOxIn CoV-19 vaccine prevents SARS-CoV-2 pneumonia in rhesus macaques," Nature, vol. 586, https://doi.org/10.1038/s41586-020-2608-y, pp. 578-582 (2020).
Engelhardt, J., et al., "Ablation of E2A in Recombinant Adenoviruses Improves Transgene Persistence and Decreases Inflammatory Response in Mouse Liver," Proceedings of the National Academy of Sciences of the United States of America, vol. 91, No. 13, pp. 6196-6200 (1994).
Farina , S. et al., "Replication-Defective Vector Based on a Chimpanzee Adenovirus", Journal of Virology, vol. 75, No. 23, pp. 11603-11613 (2001).
Fisher, W., et al., "Polyvalent vaccines for optimal coverage of potential T-cell epitopes in global HIV-1 variants," Nat. Med., vol. 13, No. 1, pp. 100-106 (2007).
Fischinger, S., et al., "A high-throughput, bead-based, antigen-specific assay to assess the ability of antibodies to induce complement activation," J Immunol Methods, vol. 473, 112630, doi:10.1016/j.jim.2019.07.002, pp. 1-12 (2019).
Gao, Q., et al., "Development of an inactivated vaccine candidate for SARS-CoV-2," Science, 369:77-81, doi:10.1126/science.abc1932 (2020).
Gibson, D., et al., "Enzymatic assembly of DNA molecules up to several hundred kilobases," Nature Methods, vol. 6, No. 5, pp. 345-345 (2009).
Graham, B., "Rapid COVID-19 vaccine development," Science, vol. 368, No. 6494, pp. 945-946, doi:10.1126/science.abb8923 (2020).
Guebre-Xabier, M., et al., "NVX-CoV2373 vaccine protects cynomolgus macaque upper and lower airways against SARS-CoV-2 challenge," Vaccine 38(50):7892-6 (2020).
Havenga, M., et al., "Novel Replication-Incompetent Adenoviral B-Group Vectors: High Vector Stability and Yield in PER. C6 Cells," J. Gen. Virol., vol. 87, pp. 2135-2143 (2006).
Hoganson, D., et al., "Development of a Stable Adenoviral Vector Formulation," BioProcessing Journ., pp. 43-48 (2002).
Holshue, M., et al. , "First Case of 2019 Novel Coronavirus in the United States," N Engl J Med, vol. 382, No. 10. pp. 929-936, doi:10.1056/NEJMoa2001191 (2020).
Huang, C., et al., "Clinical features of patients infected with 2019 novel coronavirus in Wuhan, China," Lancet, vol. 395, pp. 497-506, doi:10.1016/S0140-6736(20)30183-5 (2020).
Imai, M., et al., "Syrian hamsters as a small animal model for SARS-CoV-2 infection and countermeasure development," Proc Natl Acad Sci USA, vol. 117, No. 28, pp. 16587-16595, doi:10.1073/pnas.2009799117 (2020).
Joyce, G., et al., "A Cryptic Site of Vulnerability on the Receptor Binding Domain of the SARS-CoV-2 Spike Glycoprotein," BioRxiv, pp. 1-32, doi: https://doi.org/10.1101/2020.03.15.992883 (2020).
Kim, Y., et al., "Infection and Rapid Transmission of SARS-CoV-2 in Ferrets," Cell Host Microbe 27, pp. 704-709 e702, doi:10.1016/j.chom.2020.03.023 (2020).
Kirchdoerfer, R., et al., "Pre-fusion structure of a human coronavirus spike protein," Nature, vol. 531, pp. 118-121, doi:10.1038/nature17200 (2016).
Kobinger, G., et al., "Chimpanzee adenovirus vaccine protects against Zaire Ebola virus," Virology, vol. 346, pp. 394-401 (2006).
Kobinger, G., et al., "Adenovirus-based vaccine prevents pneumonia in ferrets challenged with the SARS coronavirus and stimulates robust immune responses in macaques," Vaccine 25, pp. 5220-5231 (2007).
Kochanek , S. et al., "A New Adenoviral Vector: Replacement of All Viral Coding Sequences with 28 kb of DNA Independently Expressing Both Full-Length Dystrophin and Beta-Galactosidase," Proceedings of the National Academy of Sciences of the United States of America, vol. 93, No. 12, pp. 5731-5736 (1996).
Lasaro, M., et al., "New Insights on Adenovirus as Vaccine Vectors," Molecular Therapy, vol. 17, No. 8, pp. 1333-1339 (2009).
Lester, S., et al., "Middle East respiratory coronavirus (MERS-CoV) spike (S) protein vesicular stromatitis virus pseudoparticle neutralization assaysoffer a reliable alternative to the conventional neutralization assay in human seroepidemilogical studies," Access Microbiology, vol. 1, No. 9 (2019), 9 pages.
Li, Q., et al., "Early Transmission Dynamics in Wuhan, China, of Novel Coronavirus-Infected Pneumonia," N Engl J Med, vol. 382, No. 13, pp. 1199-1207, doi:10.1056/NEJMoa2001316 (2020).
Lin, J., et al., "Highly multiplexed immunofluorescence imaging of human tissues and tumors using t-CyCIF and conventional optical microscopes," eLife 7, pp. 1-46 (2018).
Liu, R., et al., "A recombinant VSV-vectored MERS-CoV vaccine induces neutralizing antibody and T cell responses in rhesus monkeys after single dose immunization," Antiviral Research, vol. 150, pp. 30-38 (2018).
Liu, L., et al., "Anti-spike IgG causes severe acute lung injury by skewing macrophage responses during acute SARS-CoV infection," JCI insight, vol. 4, No. 4, pp. 1-19 (2019).
Lu, L., et al., "A functional role for antibodies in tuberculosis," Cell, vol. 167, No. 2, pp. 433-443 e414, doi:10.1016/j.cell.2016.08.072 (2016).
Maizel, J., et al., "The Polypeptides of Adenovirus," Virology, vol. 36, No. 1, pp. 115-125 (1968).
Martin, J., et al., "A SARS DNA vaccine induces neutralizing antibody and cellular immune responses in healthy adults in a Phase I clinical trial," Vaccine 26, pp. 6338-6343 (2008).
Mercado, N., et al., "Single-Shot Ad26 Vaccine Protects Against SARS-CoV-2 in Rhesus Macaques," Nature, vol. 586, No. 7830, pp. 583-855, doi:10.1038/s41586-020-2607-z (2020).

(56) References Cited

OTHER PUBLICATIONS

Munster, V., et al., "Respiratory disease in rhesus macaques inoculated with SARS-CoV-2," Nature, vol. 585, No. 7824, pp. 268-272, doi:10.1038/S41586-020-2324-7 (2020).
Muthumani, K., et al., "A synthetic consensus anti-spike protein DNA vaccine induces protective immunity against Middle East respiratory syndrome coronavirus in nonhuman primates," Sci Transl Med, vol. 7, No. 301, 301ra132, pp. 1-29 (2015).
Netland, J., et al., "Severe Acute Respiratory Syndrome Coronavirus Infection Causes Neuronal Death in the Absence of Encephalitis in Mice Transgenic for Human ACE2," Journal of Virology, vol. 82, No. 15, pp. 7264-7275, doi:10.1128/JVI.00737-08 (2008).
Pallesen, J., et al., "Immunogenicity and structures of a rationally designed prefusion MERS-CoV spike antigen," Proc Natl Acad Sci USA 114, pp. E7348-E7357, doi:10.1073/pnas.1707304114 (2017).
Rockx, B., et al., "Comparative pathogenesis of COVID-19, MERS, and SARS in a nonhuman primated model," Science, vol. 368, pp. 1012-1015, doi:10.1126/science.abb7314 (2020).
Sadoff, J., et al., "Interim Results of a Phase 1-2a Trial of Ad26.COV2.S Covid-19 Vaccine," New Engl. J Med, DOI: 10.1056/NEJMoa2034201 (2021), 12 pages.
Scobey, T., et al., "Reverse genetics with a full-length infectious cDNA of the Middle East respiratory syndrome coronavirus," Proc Natl Acad Sci USA, vol. 110, No. 40, pp. 16157-16162, doi:10.1073/pnas.1311542110 (2013).
Shi, J., et al., "Susceptibility of ferrets, cats, dogs, and other domesticated animals to SARS-coronavirus 2," Science, vol. 368, pp. 1016-1020, doi:10.1126/science.abb7015 (2020).
Sia, S., et al., "Pathogenesis and transmission of SARS-CoV-2 in golden hamsters," Nature, vol. 583, pp. 834-838, doi:10.1038/s41586-020-2342-5 (2020).
Ogun, S., et al., "The Oligomerization Domain of C4-Binding Protein (C4bp) Acts as an Adjuvant, and the Fusion Protein Comprised of the 19-Kilodalton Merozoite Surface Protein 1 Fused with the Murine C4bp Domain Protects Mice against Malaria," Infection and Immunity, vol. 76, No. 8, pp. 3817-3823 (2008).
Sun, S., et al., "A Mouse Model of SARS-CoV-2 Infection and Pathogenesis," Cell Host Microbe 28, pp. 124-133 e124, doi:10.1016/j.chom.2020.05.020 (2020).
Tatsis, N., et al., "A CD46-binding Chimpanzee Adenovirus Vector as a Vaccine Carrier", Mol. Therapy, vol. 15, No. 3, pp. 608-617 (2007).
Ter Meulen, J., et al., "Human Monoclonal Antibody Combination against SARS Coronavirus: Synergy and Coverage of Escape Mutants," PLOS Medicine, vol. 3, No. 7, pp. 1071-1079 (2006).
Tseng, C., et al., "Immunization with SARS Coronavirus Vaccines Leads to Pulmonary Immunopathology on Challenge with the SARS Virus," PLoS ONE 7, vol. 7, No. 4, e35421, pp. 1-13 (2012).
Vogel, A., et al., "A prefusion SARS-CoV-2 spike RNA vaccine is highly immunogenic and 2 prevents lung infection in non-human primates," BioRxiv, https://doi.org/10.1101/2020.09.08.280818, pp. 1-38 (2020).
Waddell, L., et al., "Scoping Review of the Zika Virus Literature," PLoS One, vol. 11, No. 5, e0156376, pp. 1-45 (2016).
Wattanapitayakul, S., et al., "Recent Developments in Gene Therapy for Cardiac Disease," Biomed & Pharmacother, vol. 54, No. 10, pp. 487-504 (2000).
Wolfel, R., et al., "Virological assessment of hospitalized patients with COVID-2019," Nature, vol. 581, pp. 465-469 doi:10.1038/S41586-020-2196-x (2020).

Wrapp, D., et al., "Cryo-EM structure of the 2019-nCoV spike in the prefusion confirmation," Science, vol. 367, pp. 1260-1263, doi:10.1126/science.abb2507 (2020).
Wu, F., "A new coronavirus associated with human respiratory disease in China," Nature, vol. 579, pp. 265-269 (2020).
Yang, X., et al., "Highly Stable Trimers Formed by Human Immunodeficiency Virus Type 1 Envelope Glycoproteins Fused with the Trimeric Motif of T4 Bacteriophage Fibritin,"J. Virol., vol. 76, No. 9, pp. 4634-4642 (2002).
Yang, Z., et al., "A DNA vaccine induces SARS coronavirus neutralization and protective immunity in mice," Nature, vol. 428, pp. 561-564, doi:10.1038/nature02463 (2004).
Yount, B., et al., "Reverse genetics with a full-length infectious cDNA of severe acute respiratory syndrome coronavirus," Proc Natl Acad Sci USA, vol. 100, No. 22, pp. 12995-13000, doi:10.1073/pnas.1735582100 (2003).
Yu, J., et al., "DNA vaccine protection against SARS-CoV-2 in rhesu macaques," Science, vol. 369, No. 6505, pp. 806-811. https://doi.org/10.1126/science.abc6284, (2020).
Yuan, M., et al., "A highly conserved cryptic epitope in the receptor binding domains of SARS-CoV-2 and SARS-CoV," Science, No. 368, eabb7269. doi: 10.1126/science.abb7269, pp. 1-4 (2020).
Zahn, R., "Ad35 and Ad26 Vaccine Vectors Induce Potent and Cross-Reactive Antibody and T-Cell Responses to Multiple Filovirus Species", PLOS ONE, vol. 7, No. 12, doi:10.1371/journal.pone.0044115, p. e44115, XP055159321 (2012).
Zammarchi, L., et al., "Zika virus infections imported to Italy: Clinical, immunological and virological findings, and public health implications," J. Clin. Virol., vol. 63, pp. 32-35 (2015).
Zhou, P., et al., "A pneumonia outbreak associated with a new coronavirus of probable bat origin," Nature, vol. 579, pp. 270-273, doi:10.1038/s41586-020-2012-7 (2020).
Zhou, J., et al., "Immunogenicity, safety, and protective efficacy of an inactivated SARS-associated coronavirus vaccine in rhesus monkeys," Vaccine 23, pp. 3202-3209 (2005).
Zhu, N., et al., "A Novel Coronavirus from Patients with Pneumonia in China," N Engl J Med, vol. 382, No. 8, pp. 727-733, doi:10.1056/NEJMoa2001017 (2020).
Hoffmann, Markus et al. "SARS-CoV-2 Cell Entry Depends on ACE2 and TMPRSS2 and Is Blocked by a Clinically Proven Protease Inhibitor," Cell Press, vol. 181, issue 2 (Apr. 16, 2020) pp. 271-280.
Juraszek, Jarek et al. "Stabilizing the closed SARS-CoV-2 spike trimer," Nature Communications, vol. 12, No. 1, article No. 244 (Jan. 1, 2021) pp. 1-8.
Chan, Jasper Fuk-Woo et al. "Genomic characterization of the 2019 novel human-pathogenic coronavirus isolated from a patient with atypical pneumonia after visiting Wuhan," Emerging Microbes & Infections, vol. 9, issue Jan. 1, 28, 2020) pp. 221-236.
International Search Report (Form PCT/ISA/210) for International Patent Application No. PCT/US2021/015946, issued from the International Searching Authority, dated Jun. 30, 2021, 8 pages.
Written Opinion of the International Searching Authority (Form PCT/ISA/237) for International Patent Application No. PCT/US2021/015946, issued from the International Searching Authority, dated Jun. 30, 2021, 9 pages.
GenBank MN975262.1 "Wuhan seafood market pneumonia virus isolate 2019-nCov_HKU-SZ-005b_2020, complete genome" (Jan. 24, 2020) (https://www.ncbi.nlm.nih.gov/nuccore/1800242661?sat=48&satkey=350763) (Accessed Feb. 4, 2022).
GenBank QHN73810.1 "surface glycoprotein [Wuhan seafood market pneumonia virus]" (Jan. 24, 2020) (https://www.ncbi.nlm.nih.gov/protein/QHN73810.1) (Accessed Feb. 4, 2022).

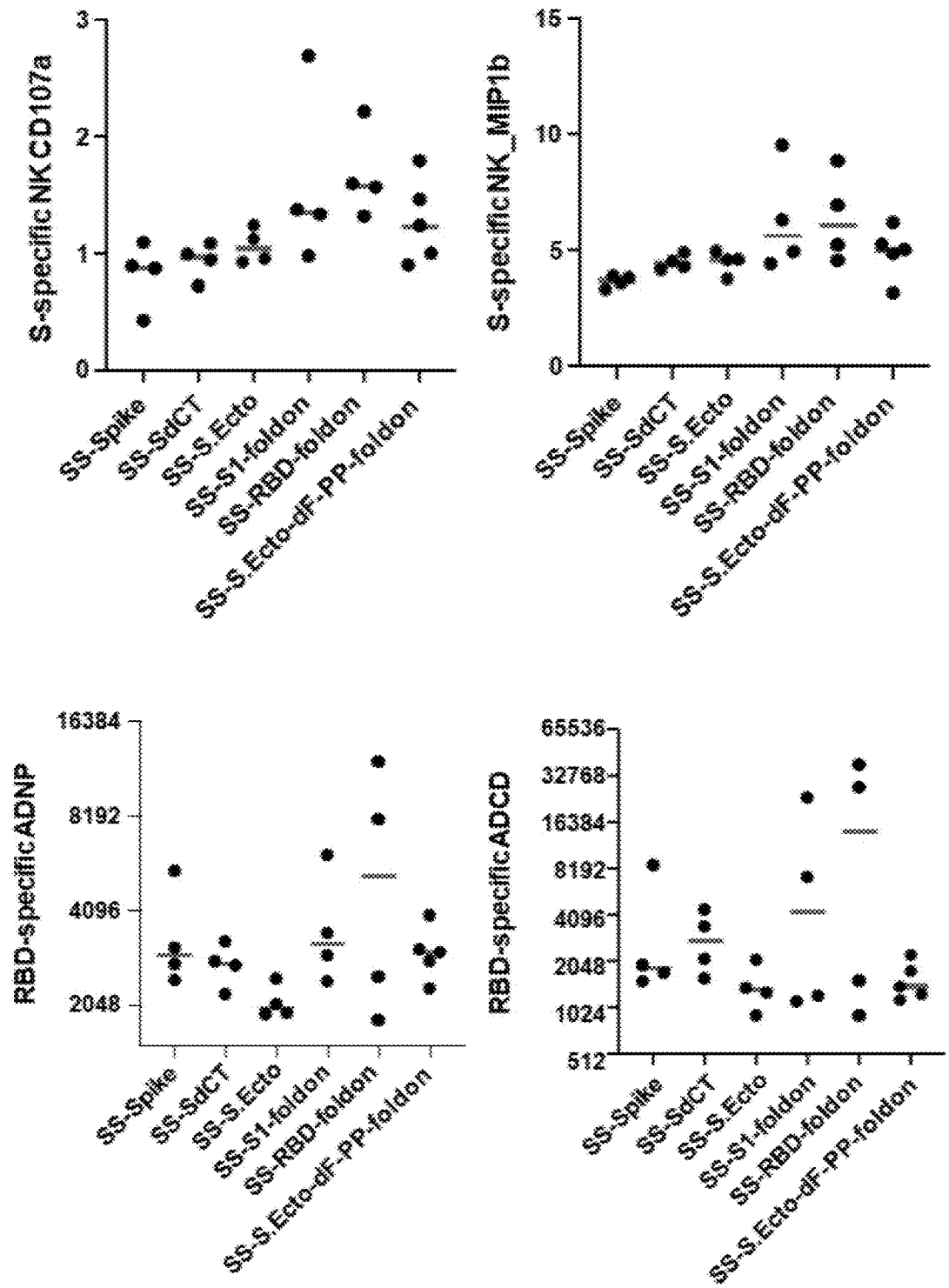
FIG. 6E—Continued

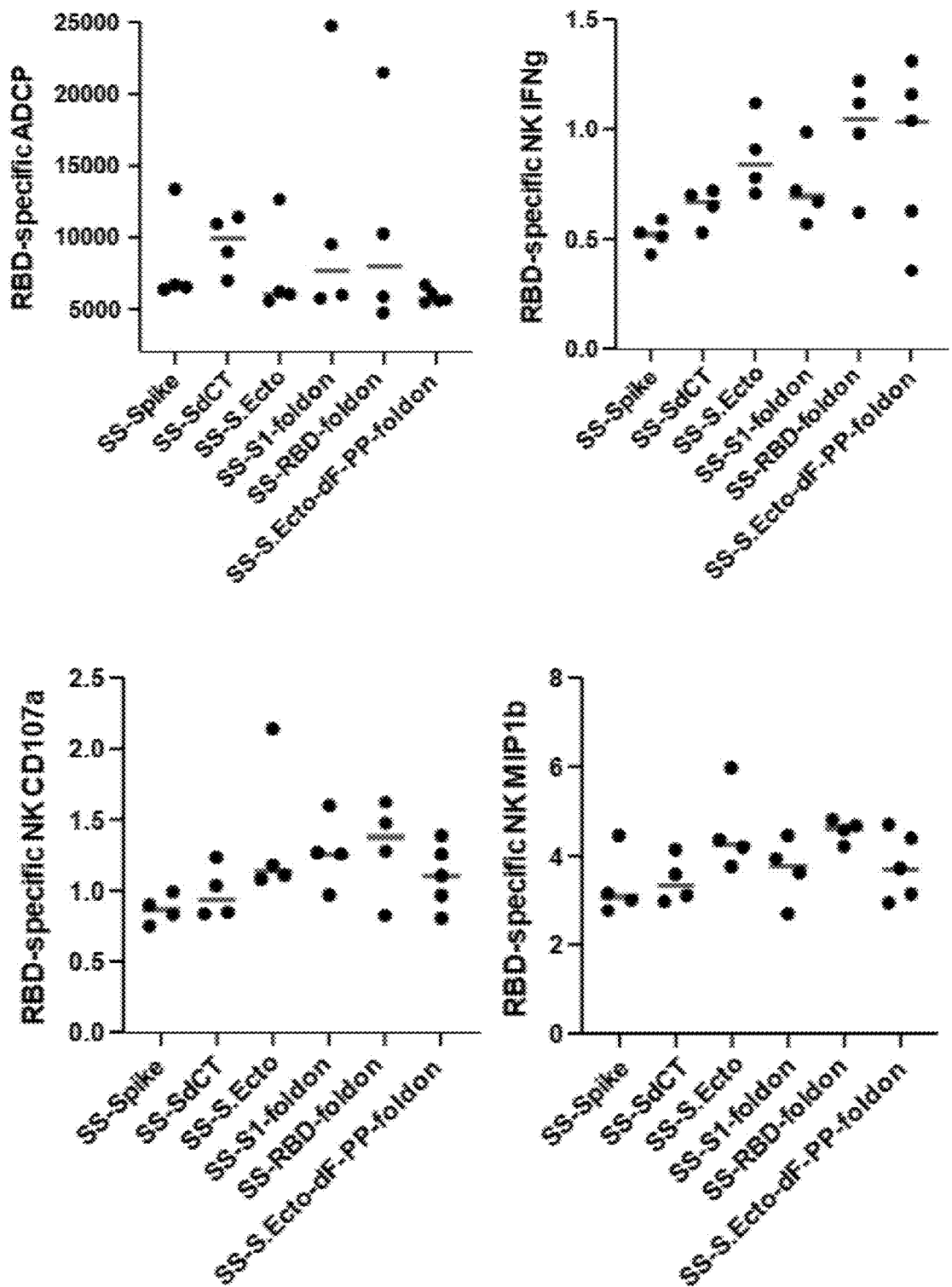
FIG. 6E—Continued

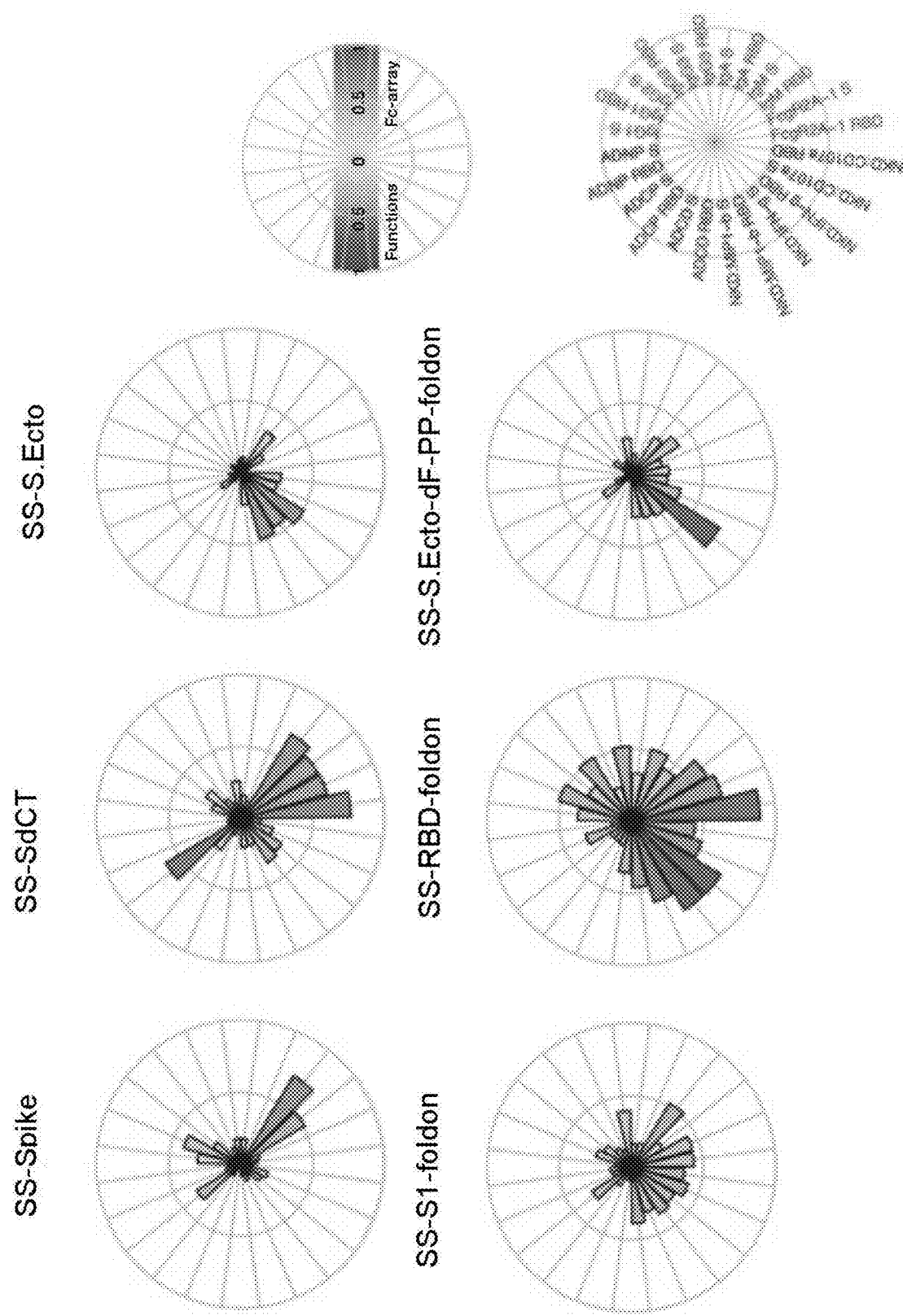
FIG. 6E—Continued

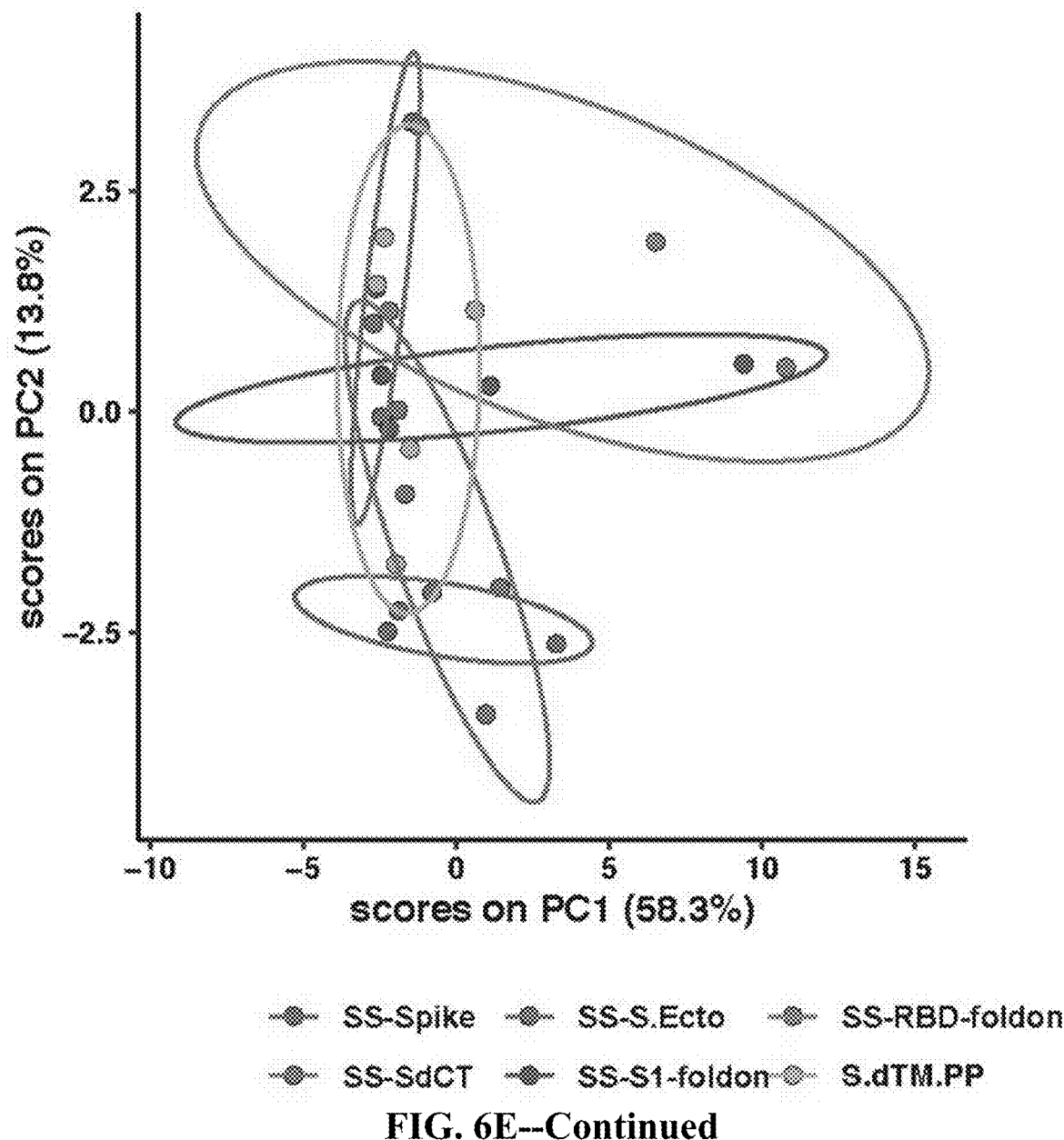
FIG. 6E--Continued

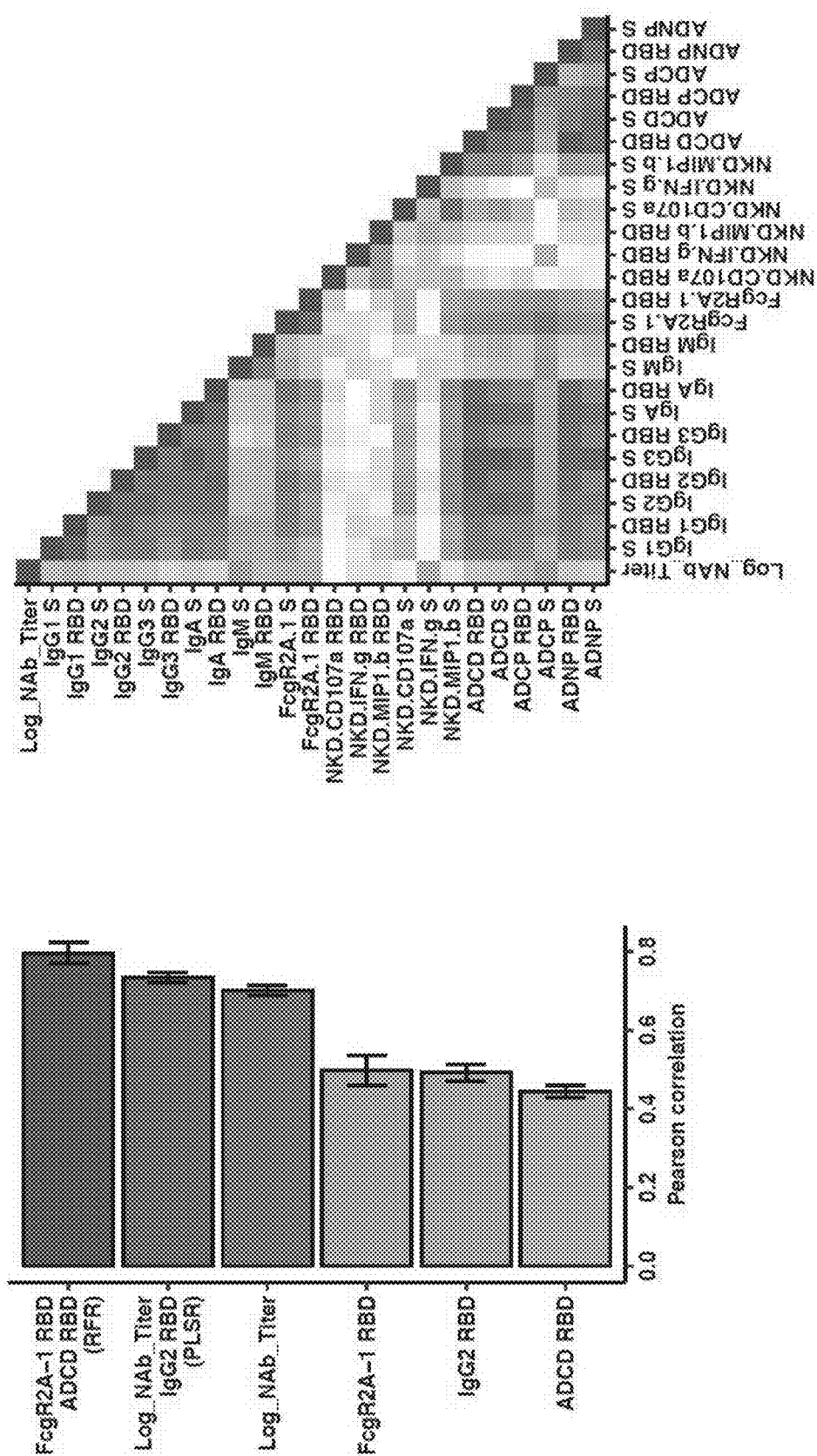
FIG. 9C--Continued

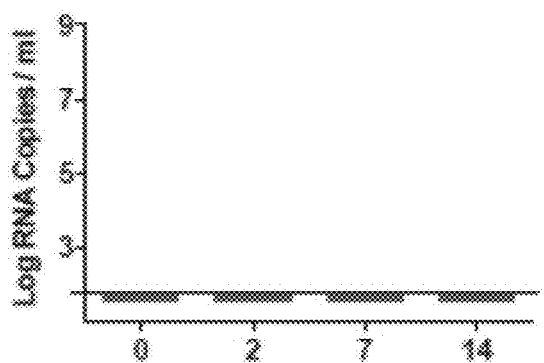
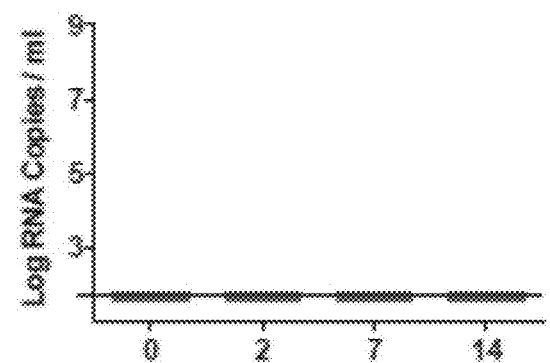
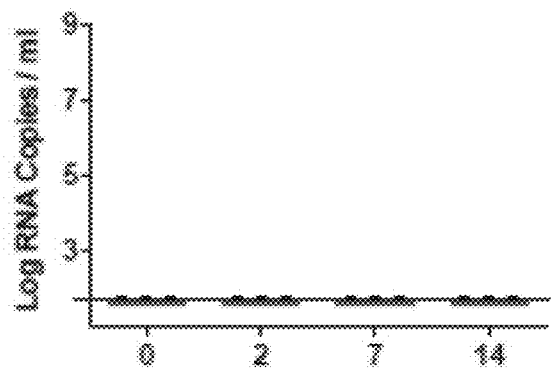
FIG. 29

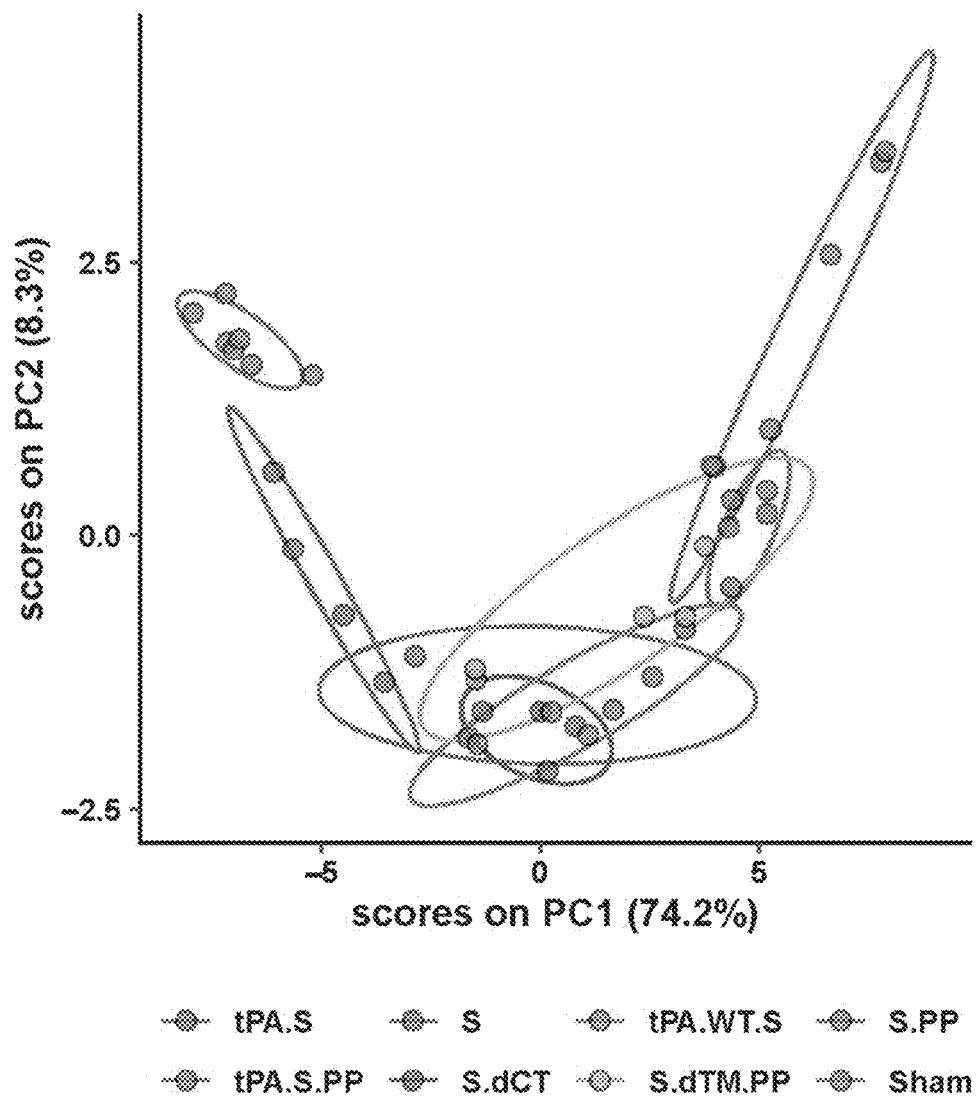
FIG. 39D—Continued

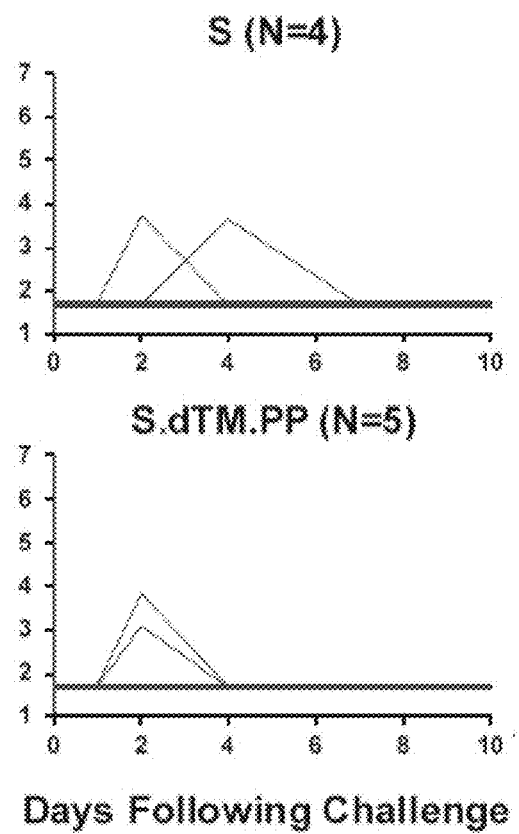
FIG. 41B--Continued
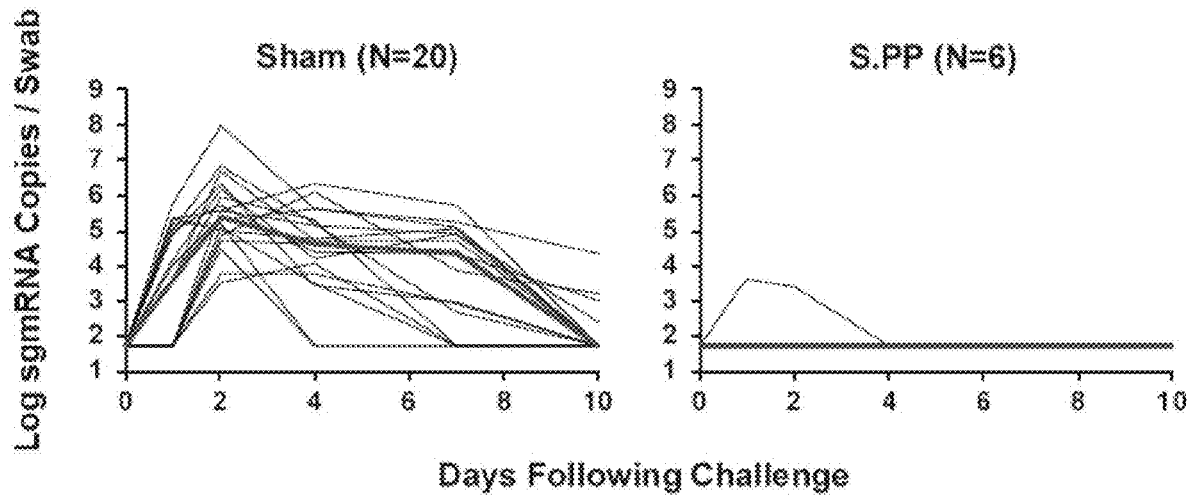
FIG. 41C

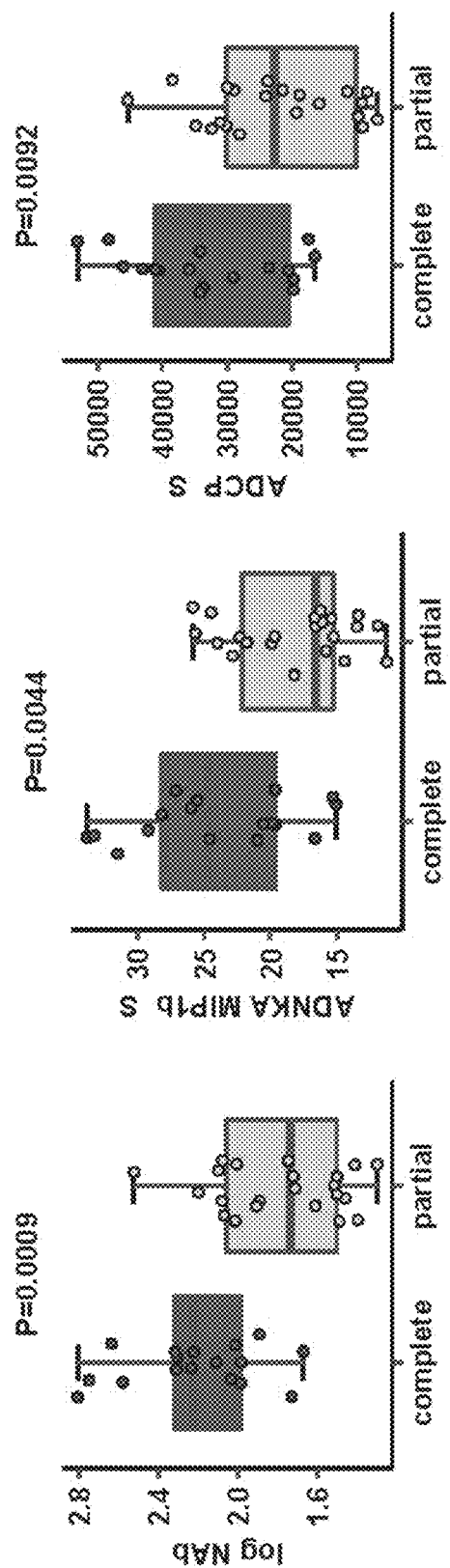
FIG. 43D—Continued

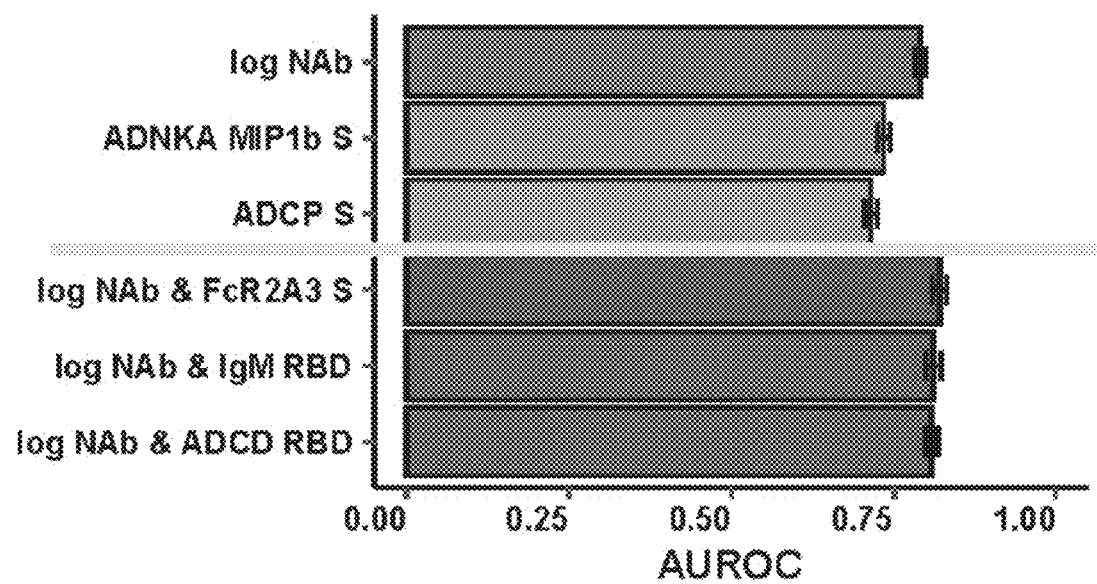
FIG. 43D—Continued
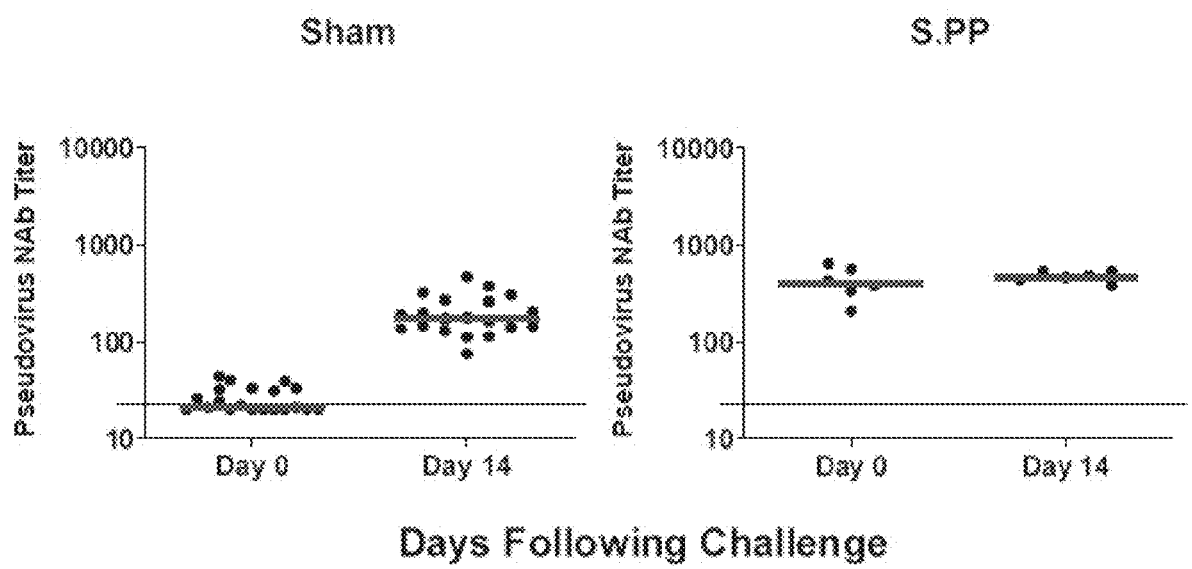
FIG. 44A

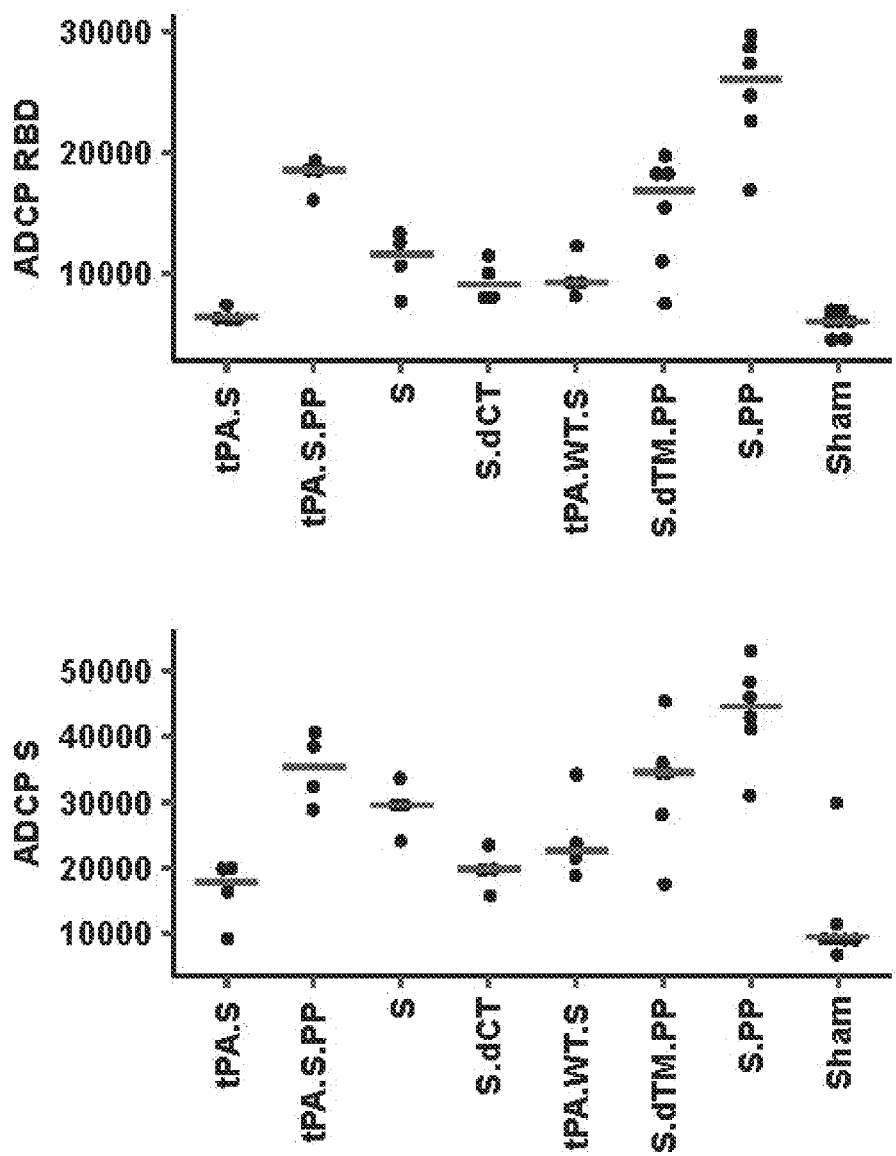
FIG. 48—Continued

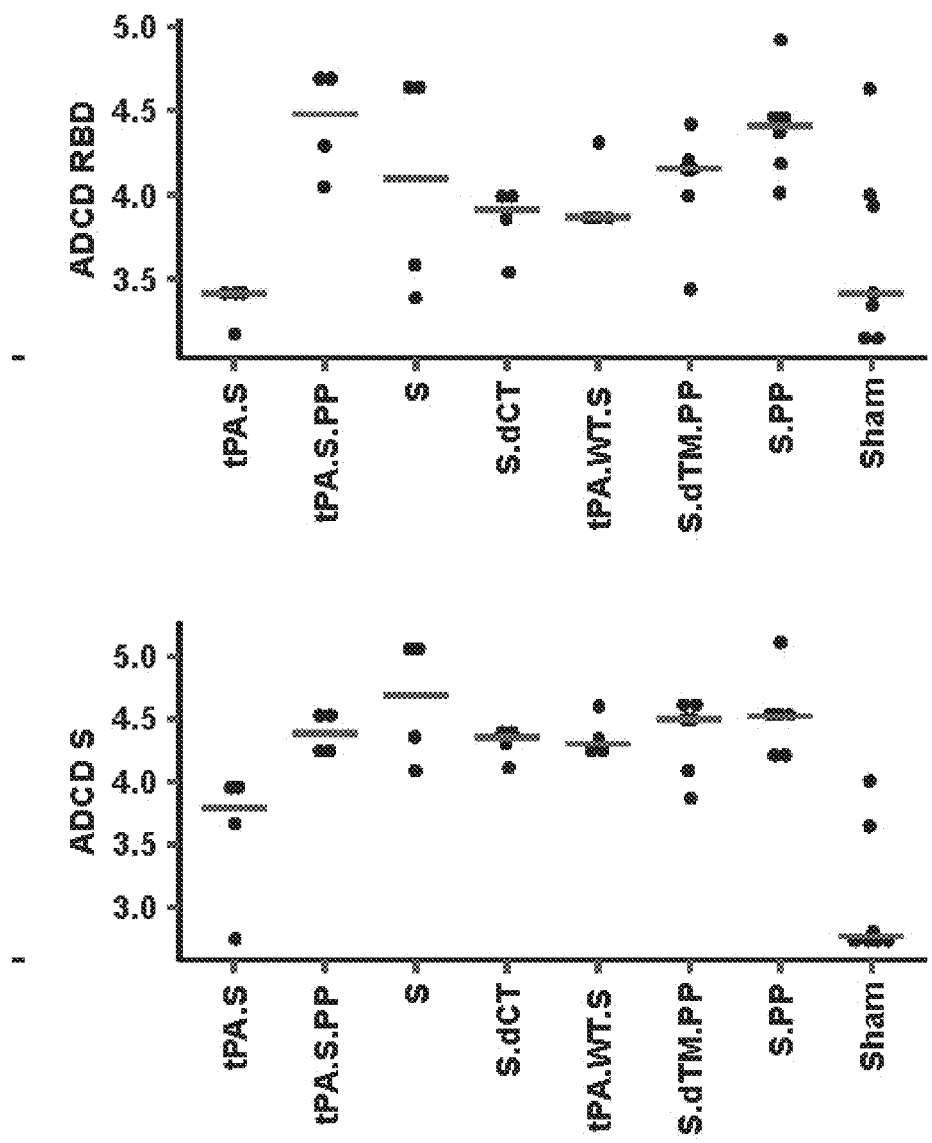
FIG. 48—Continued

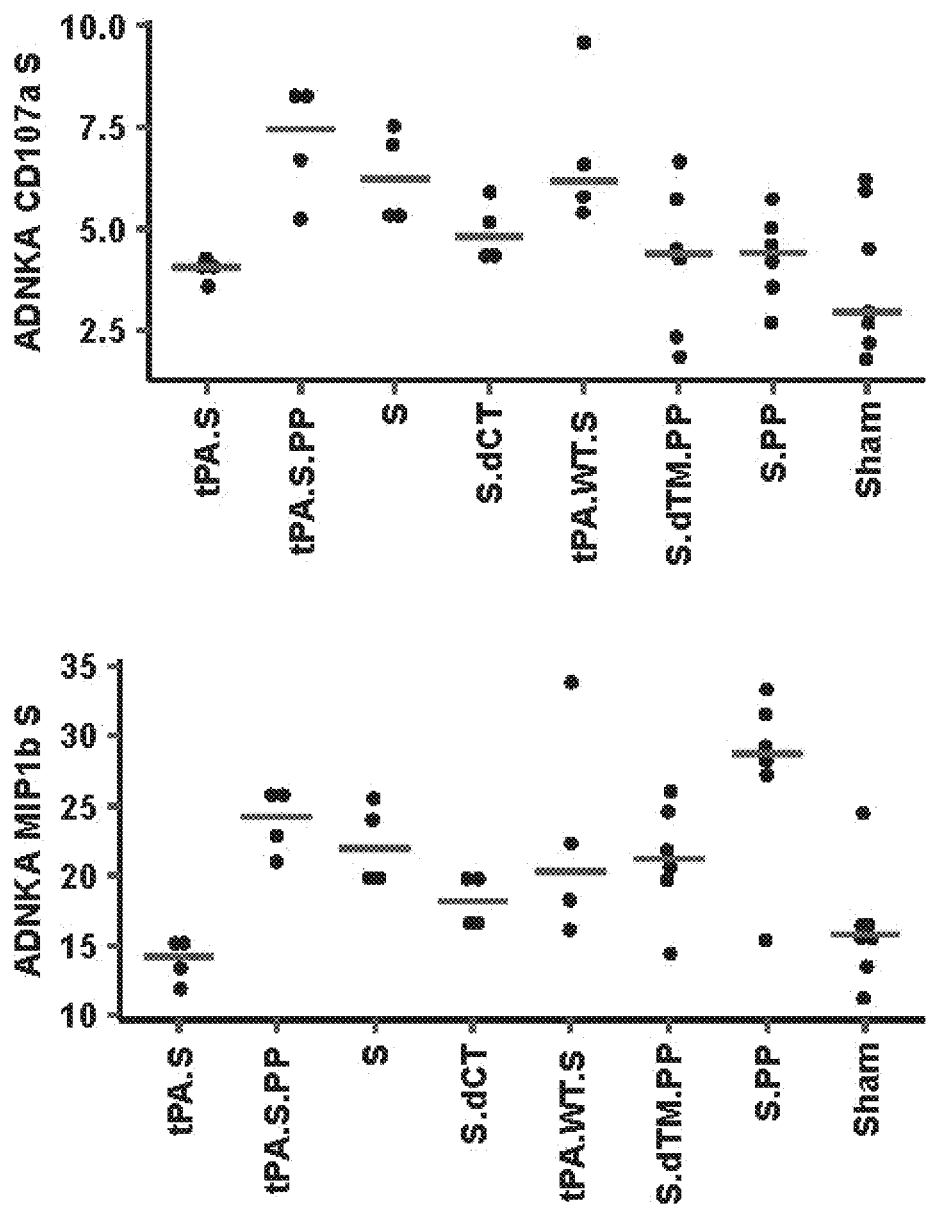
FIG. 48—Continued

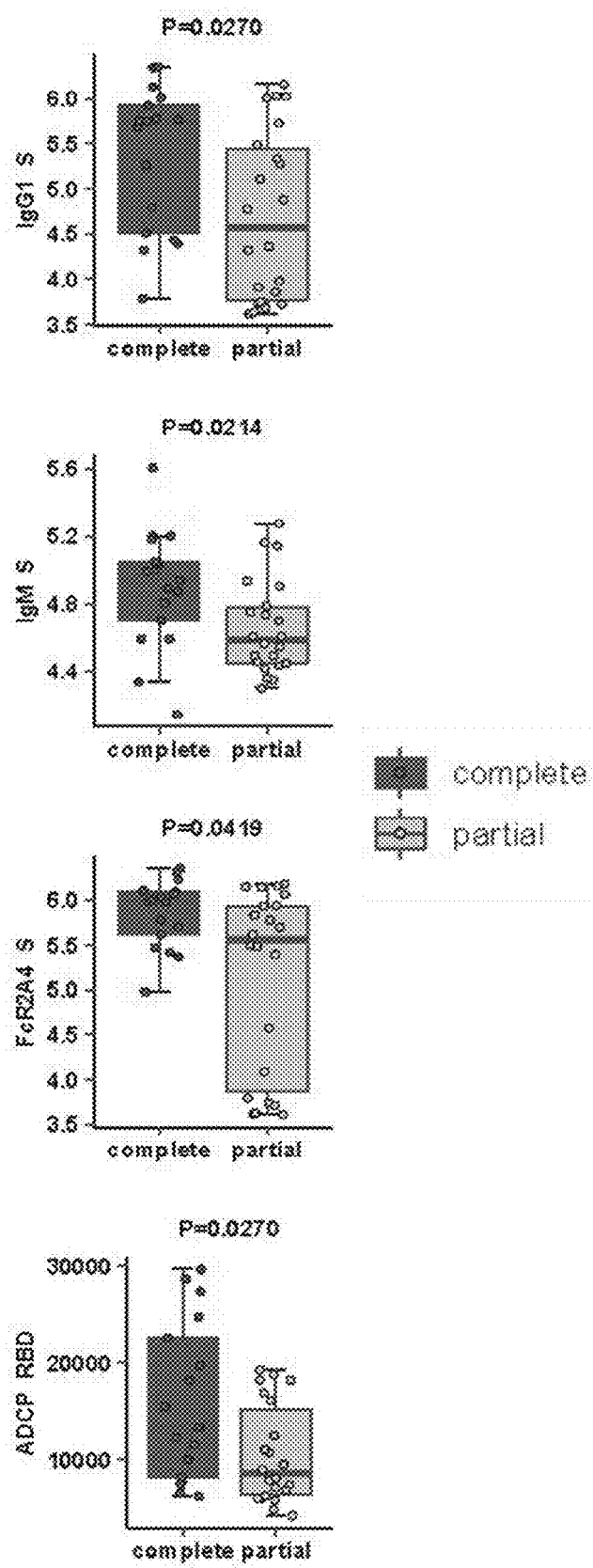
FIG. 53—Continued

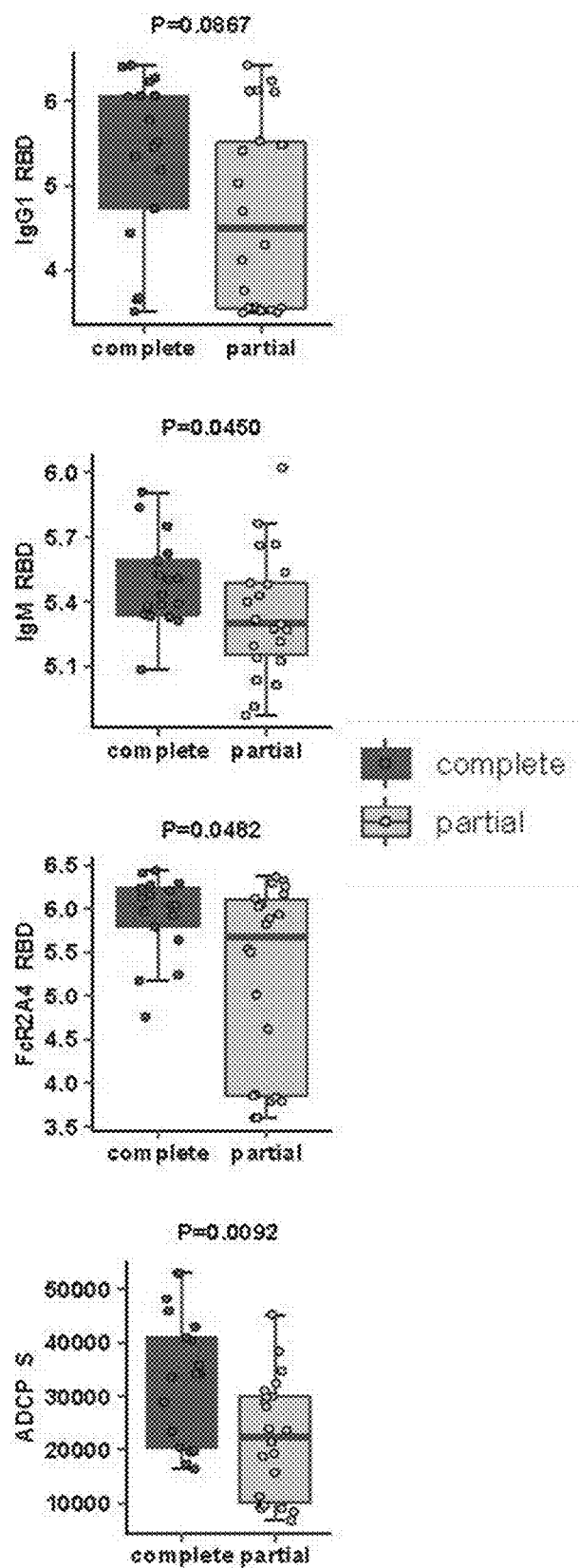
FIG. 53—Continued

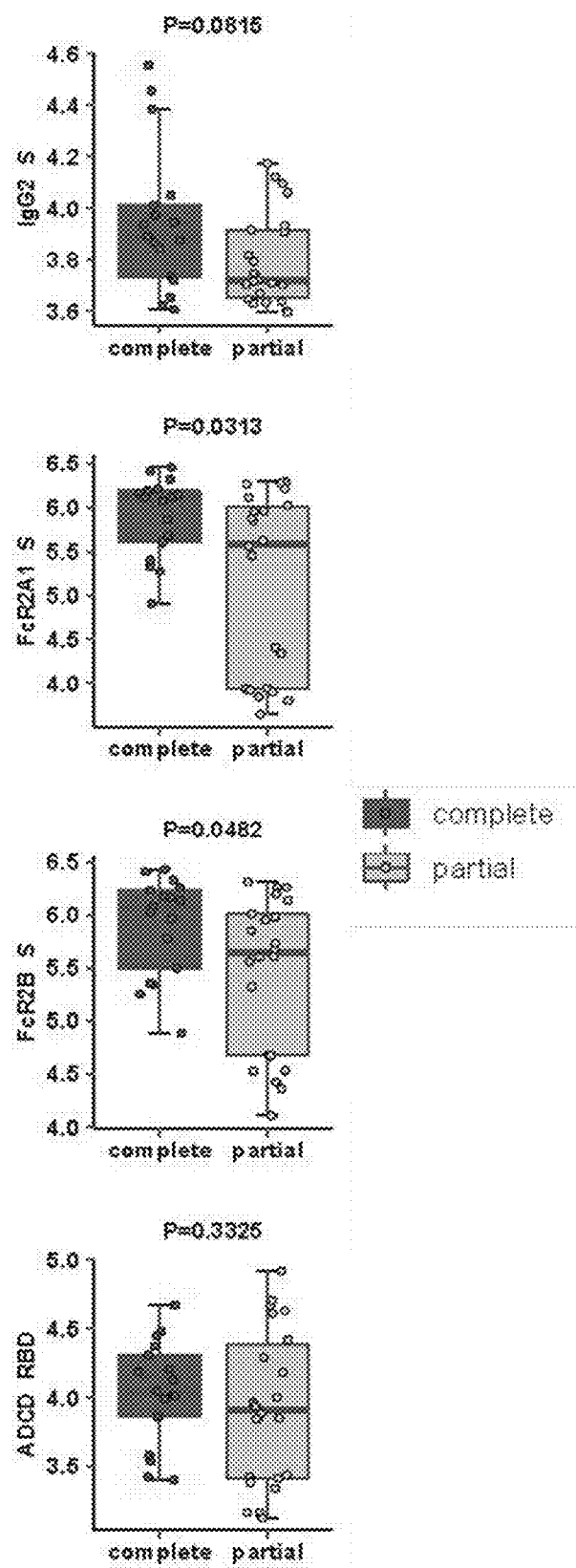
FIG. 53—Continued

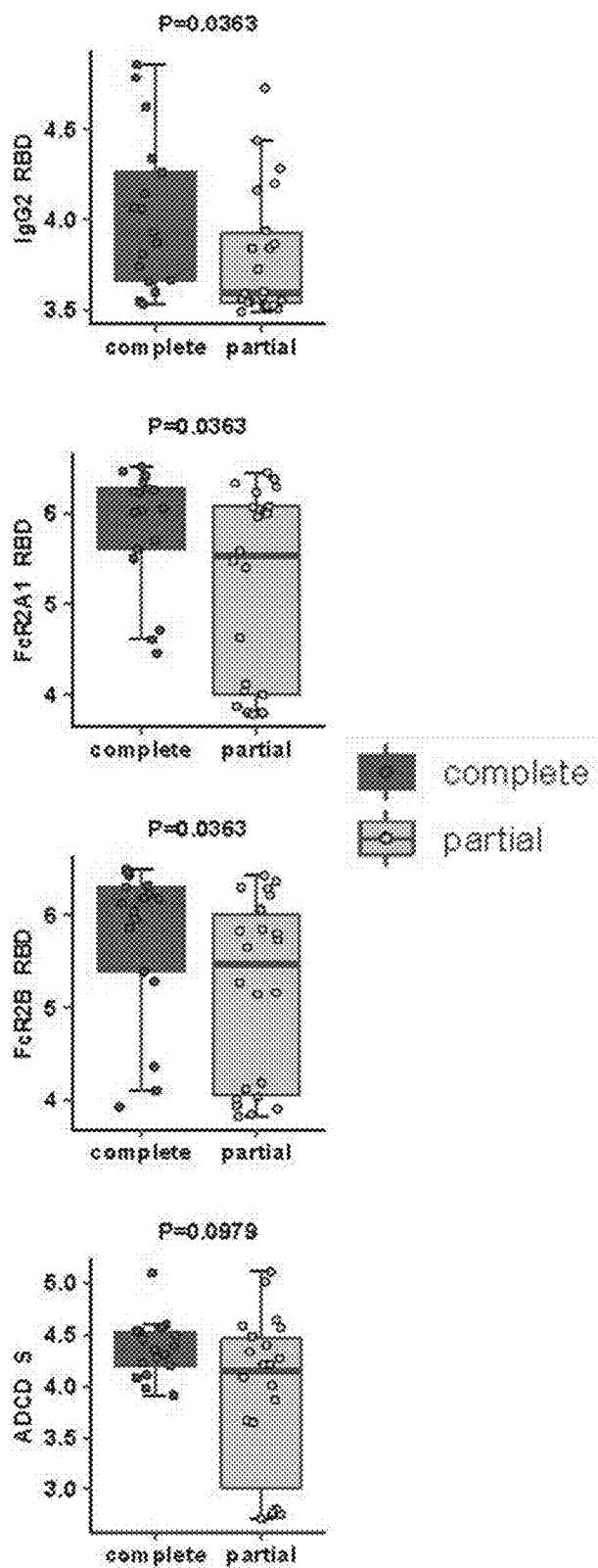
FIG. 53—Continued

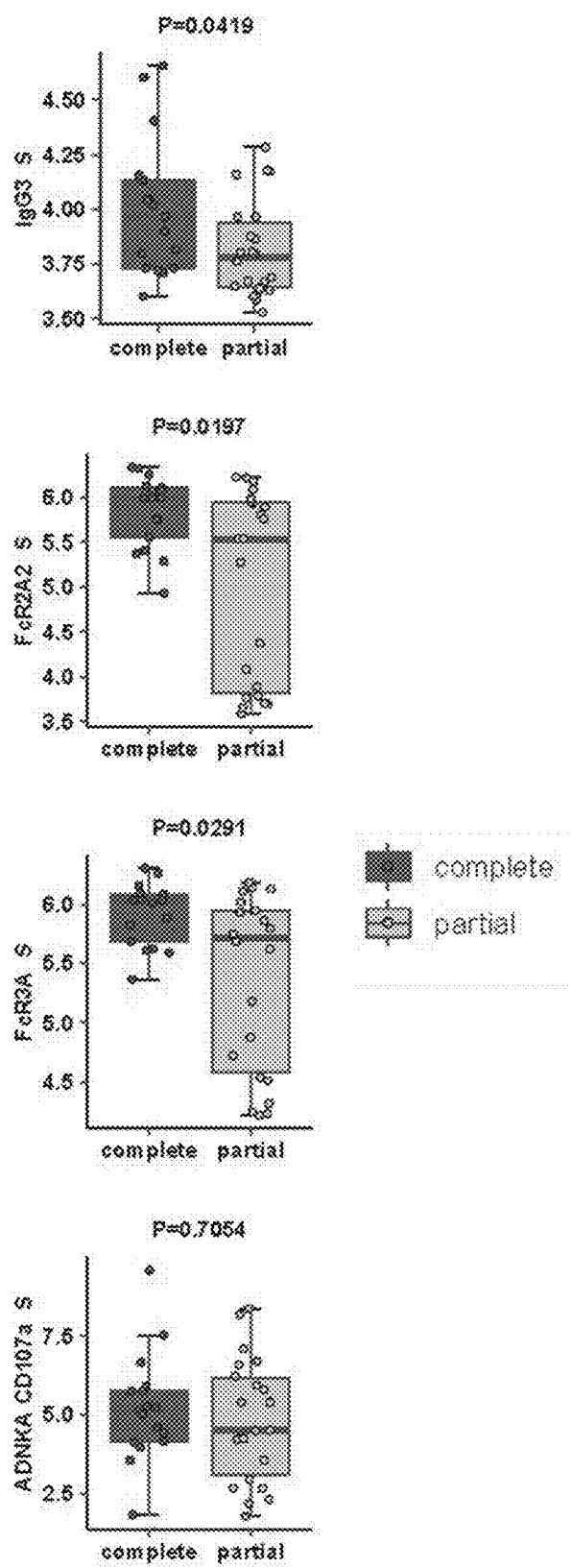
FIG. 53—Continued

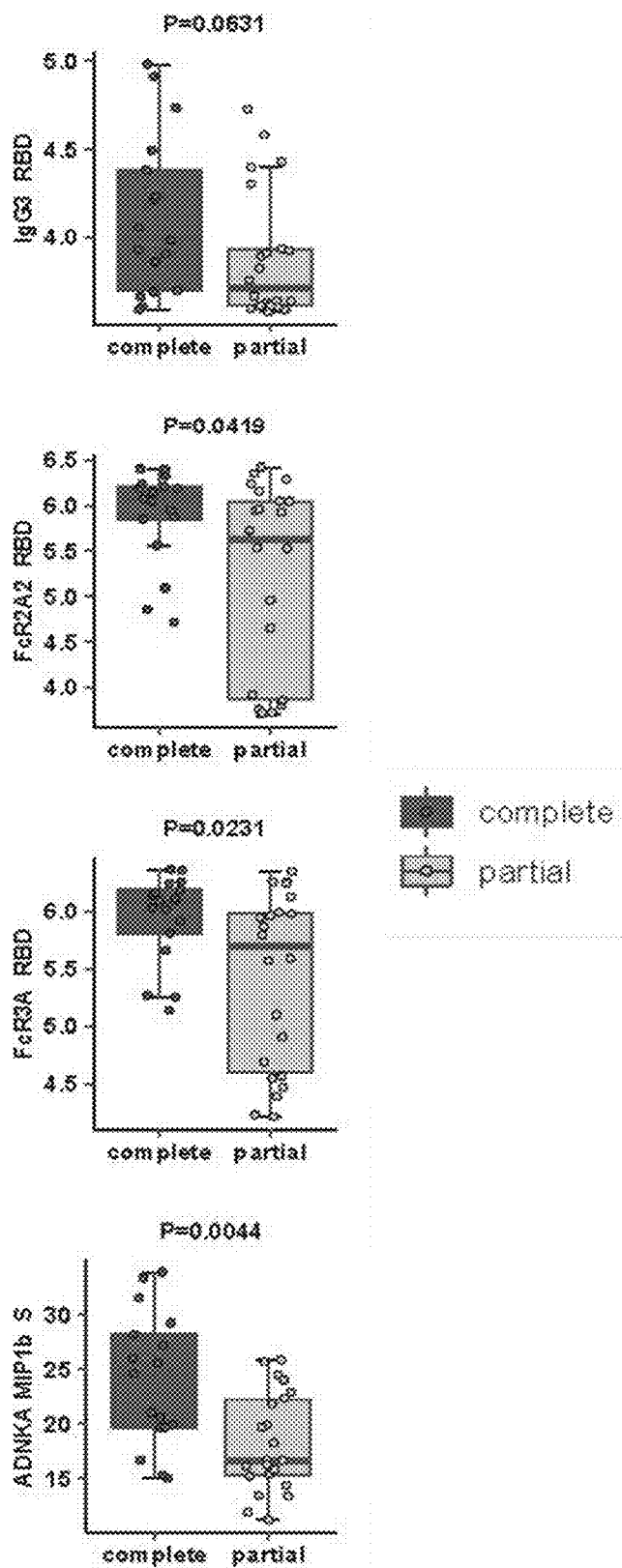
FIG. 53—Continued

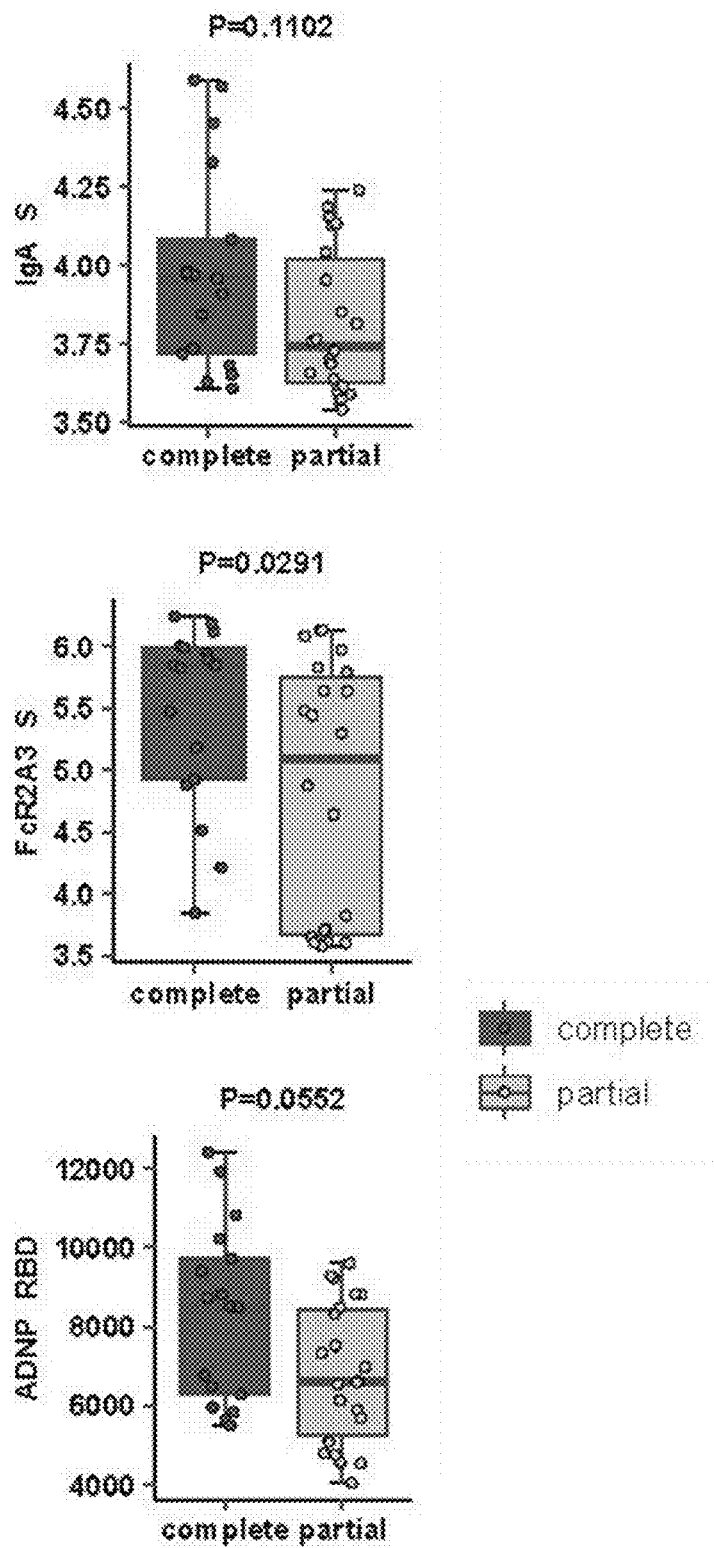
FIG. 53—Continued

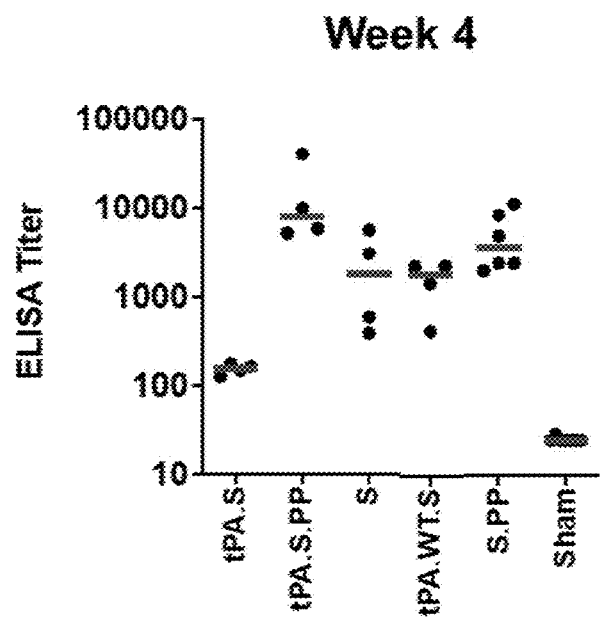
FIG. 88A – Continued
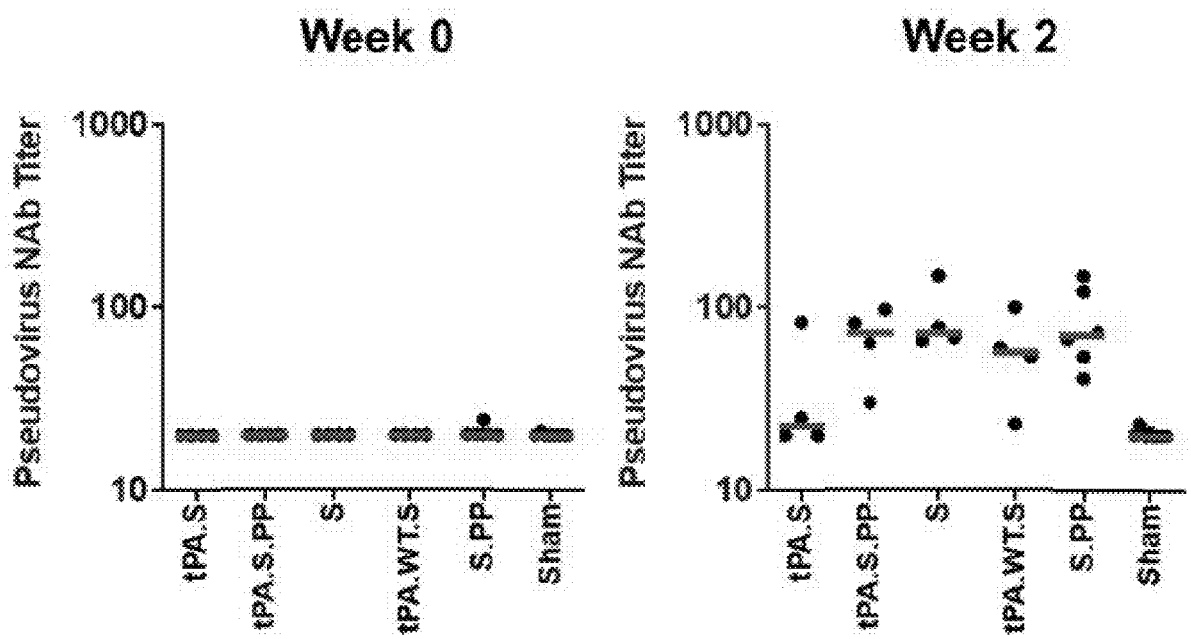
FIG. 88B

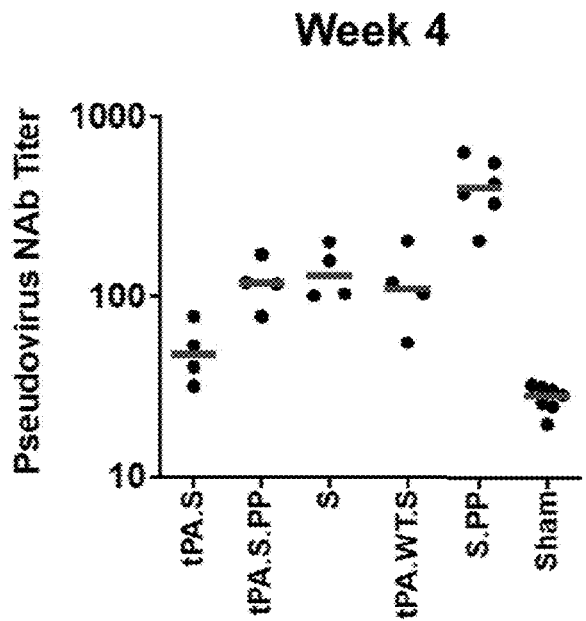
FIG. 88B - Continued
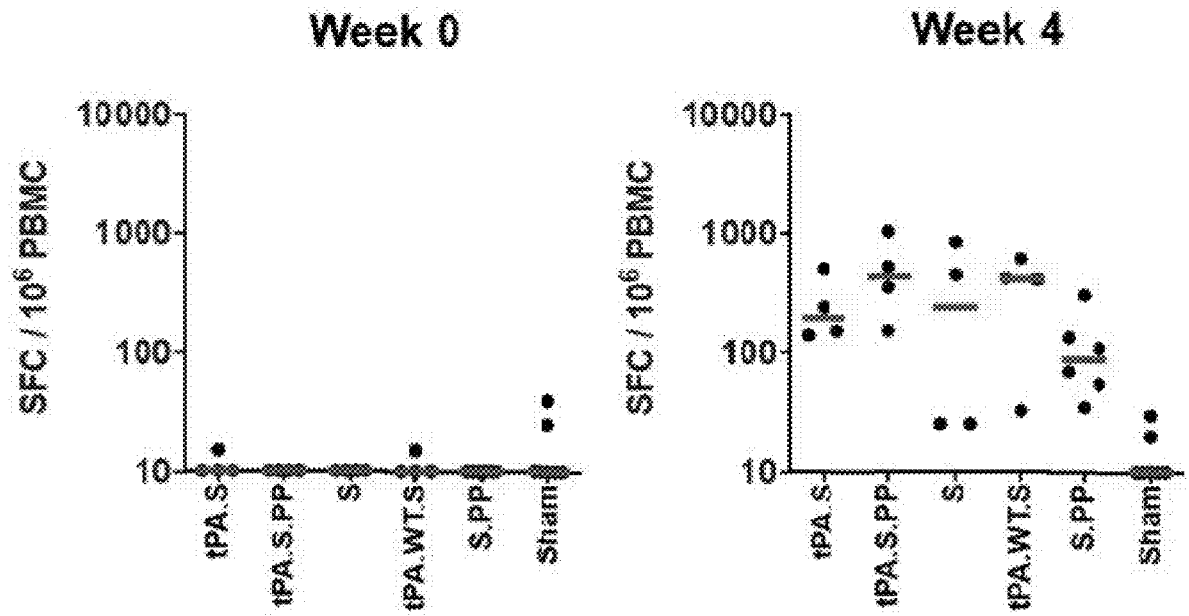
FIG. 89A

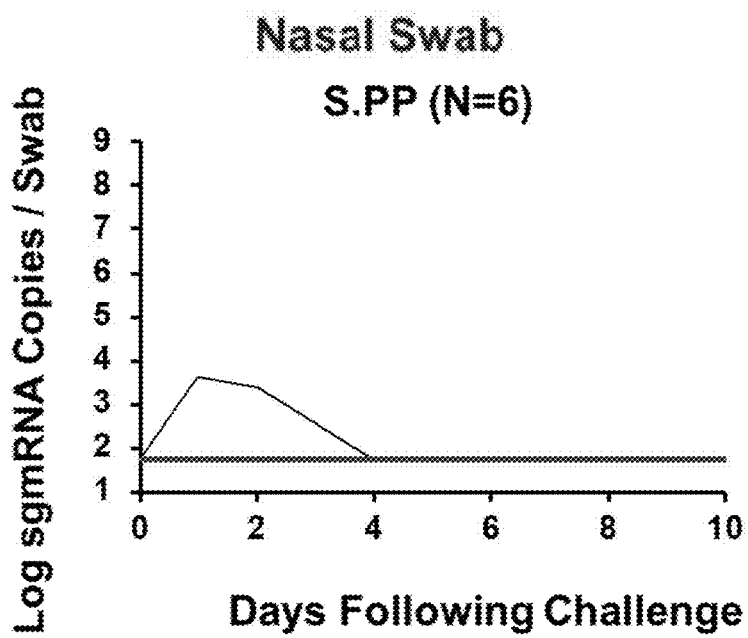
FIG. 90C – Continued
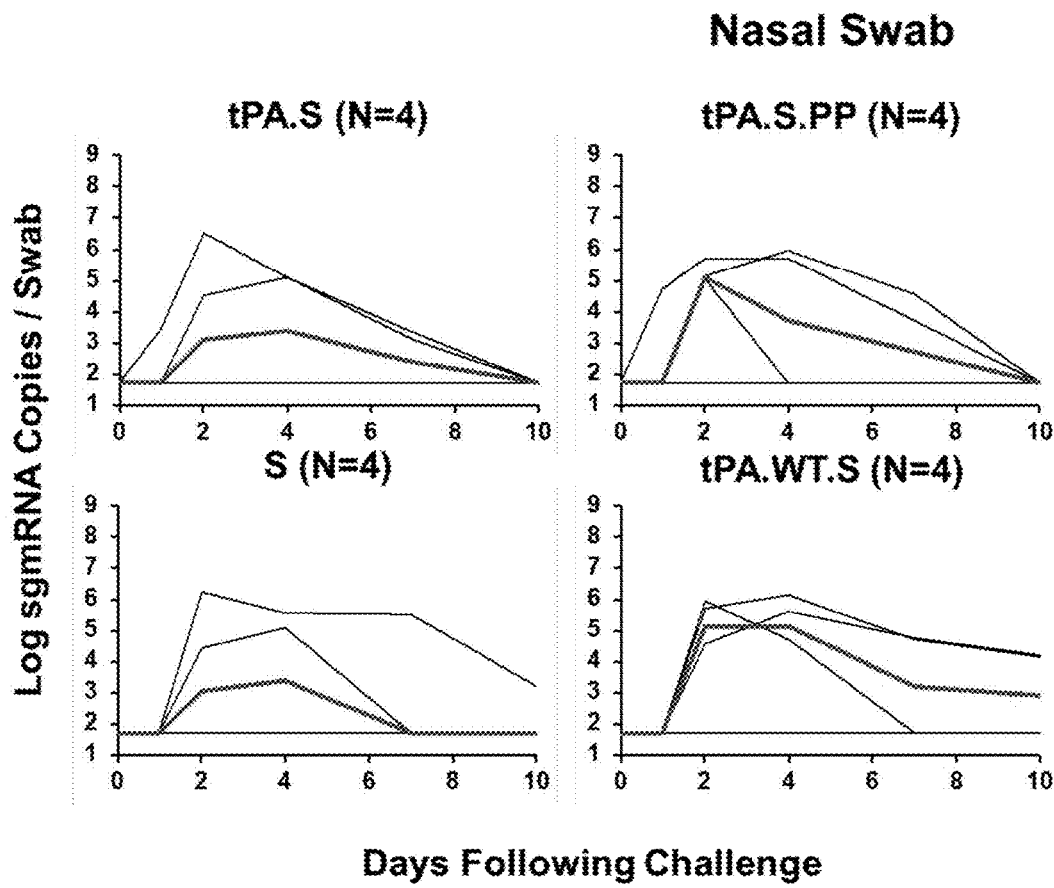
FIG. 90D

| Cohort 1a (Adults ≥18 to ≤55 years) | | | |
|---|---|---|---|
| Group | N | Day 1 (Vaccination 1) | Day 57 (Vaccination 2) |
| 1 | 75 | Ad26COVS1 5×10$^{10}$ vp | Ad26COVS1 5×10$^{10}$ vp |
| 2 | 75 | Ad26COVS1 5×10$^{10}$ vp | Placebo |
| 3 | 75 | Ad26COVS1 1×10$^{11}$ vp | Ad26COVS1 1×10$^{11}$ vp |
| 4 | 75 | Ad26COVS1 1×10$^{11}$ vp | Placebo |
| 5 | 75 | Placebo | Placebo |
| Cohort 1b (Adults ≥18 to ≤55 years) | | | |
| Group | N | Day 1 (Vaccination 1) | Day 57 (Vaccination 2) |
| 1 | 5 | Ad26COVS1 5×10$^{10}$ vp | Ad26COVS1 5×10$^{10}$ vp |
| 2 | 5 | Ad26COVS1 5×10$^{10}$ vp | Placebo |
| 3 | 5 | Ad26COVS1 1×10$^{11}$ vp | Ad26COVS1 1×10$^{11}$ vp |
| 4 | 5 | Ad26COVS1 1×10$^{11}$ vp | Placebo |
| 5 | 5 | Placebo | Placebo |
| Cohort 2a (Adults ≥18 to ≤55 years) | | | |
| Group | N | Day 1 (Vaccination 1) | Day 57 |
| 1-4 | 120 | Ad26COVS1 1×10$^{11}$ vp | No vaccination |
| 5 | 15 | Placebo | No vaccination |
| Cohort 2b (Adults ≥18 to ≤55 years) | | | |
| Group | N | Day 1 (Vaccination 1) | Day 57 (Vaccination 2) |
| 1-4 | 120 | Ad26COVS1 5×10$^{10}$ vp | Ad26COVS1 5×10$^{10}$ vp |
| 5 | 15 | Placebo | Placebo |
| Cohort 3 (Adults ≥65 years) | | | |
| Group | N | Day 1 (Vaccination 1) | Day 57 (Vaccination 2) |
| 1 | 75 | Ad26COVS1 5×10$^{10}$ vp | Ad26COVS1 5×10$^{10}$ vp |
| 2 | 75 | Ad26COVS1 5×10$^{10}$ vp | Placebo |
| 3 | 75 | Ad26COVS1 1×10$^{11}$ vp | Ad26COVS1 1×10$^{11}$ vp |
| 4 | 75 | Ad26COVS1 1×10$^{11}$ vp | Placebo |
| 5 | 75 | Placebo | Placebo |
| Total | 1,045 | | |

FIG. 101

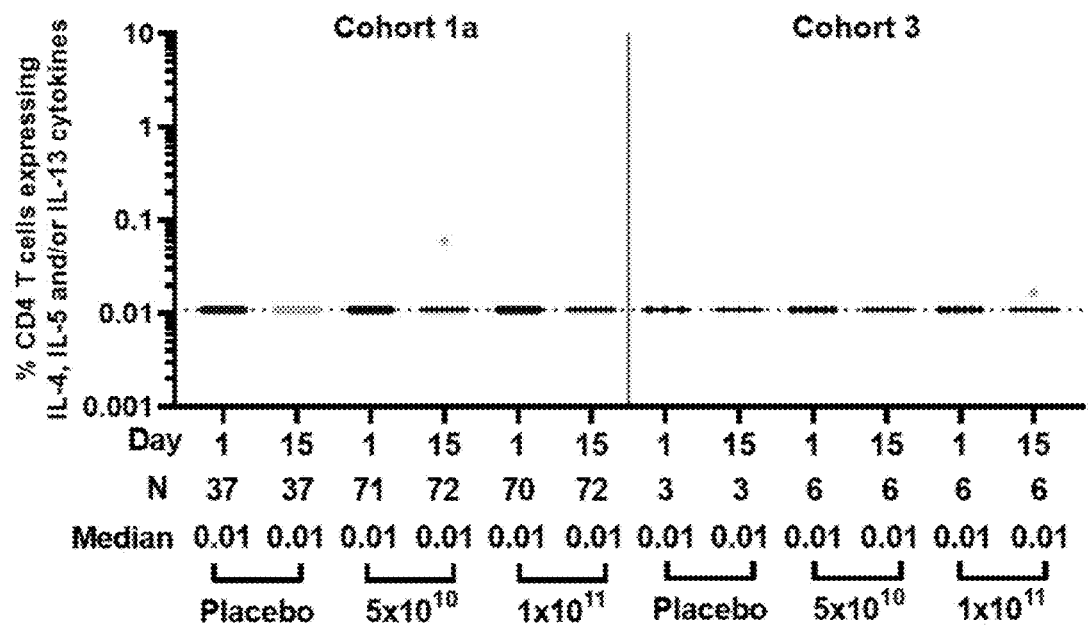
FIG. 103C—Continued
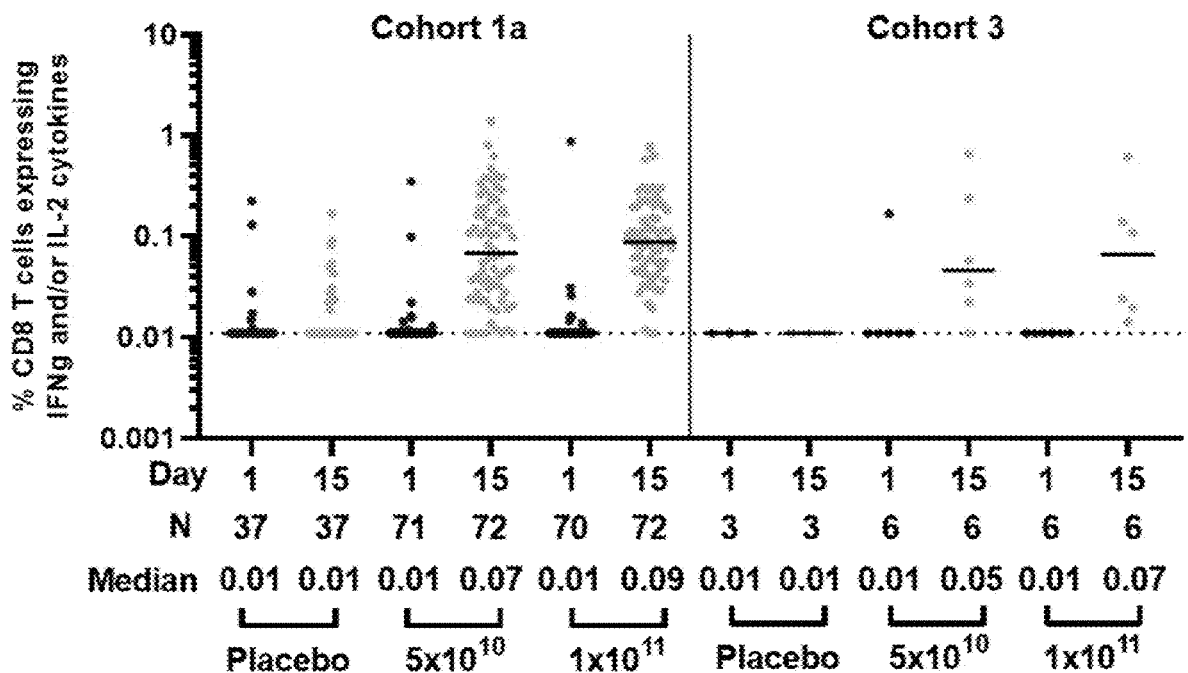
FIG. 103D

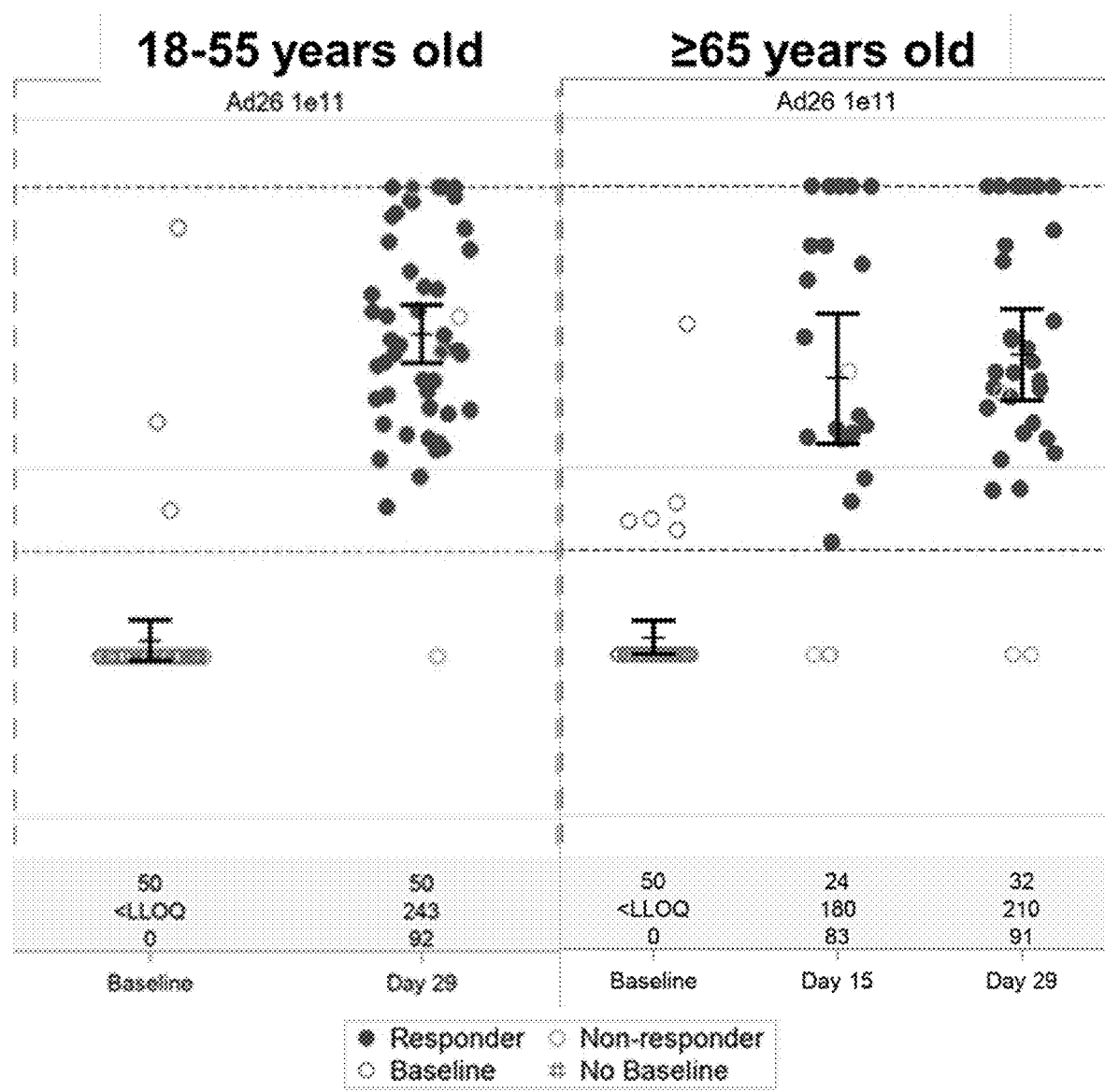
FIG. 105--Continued

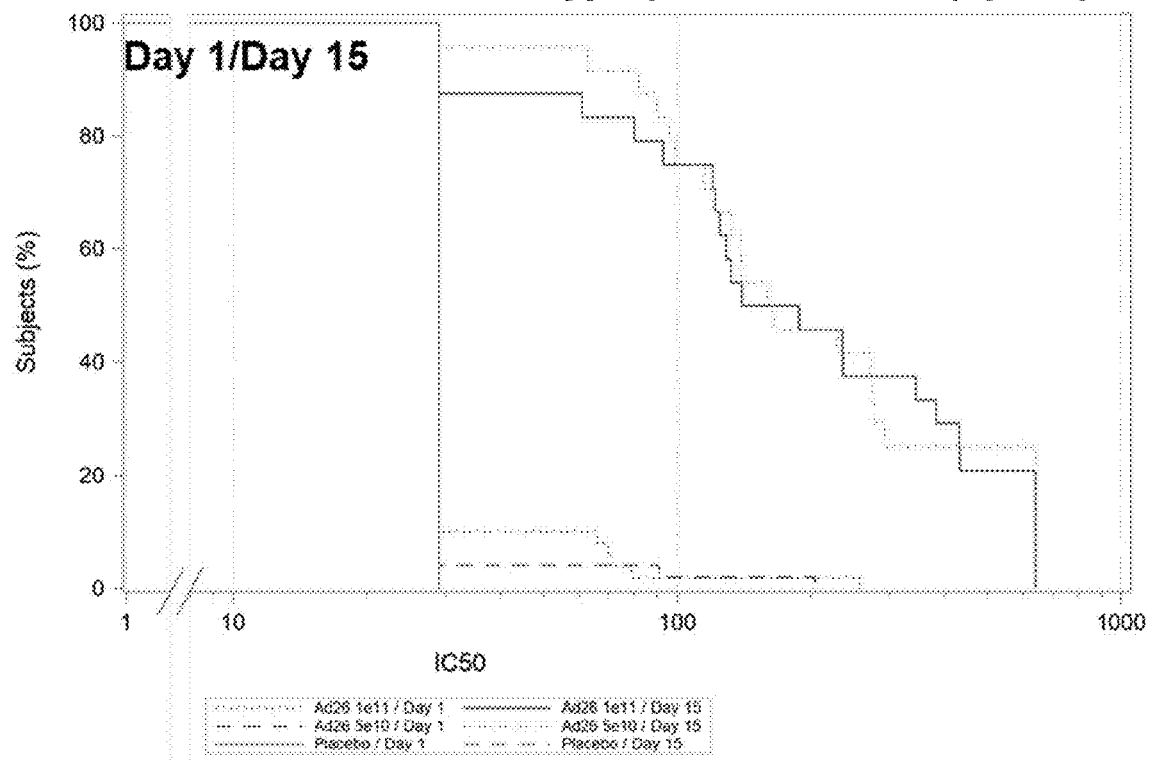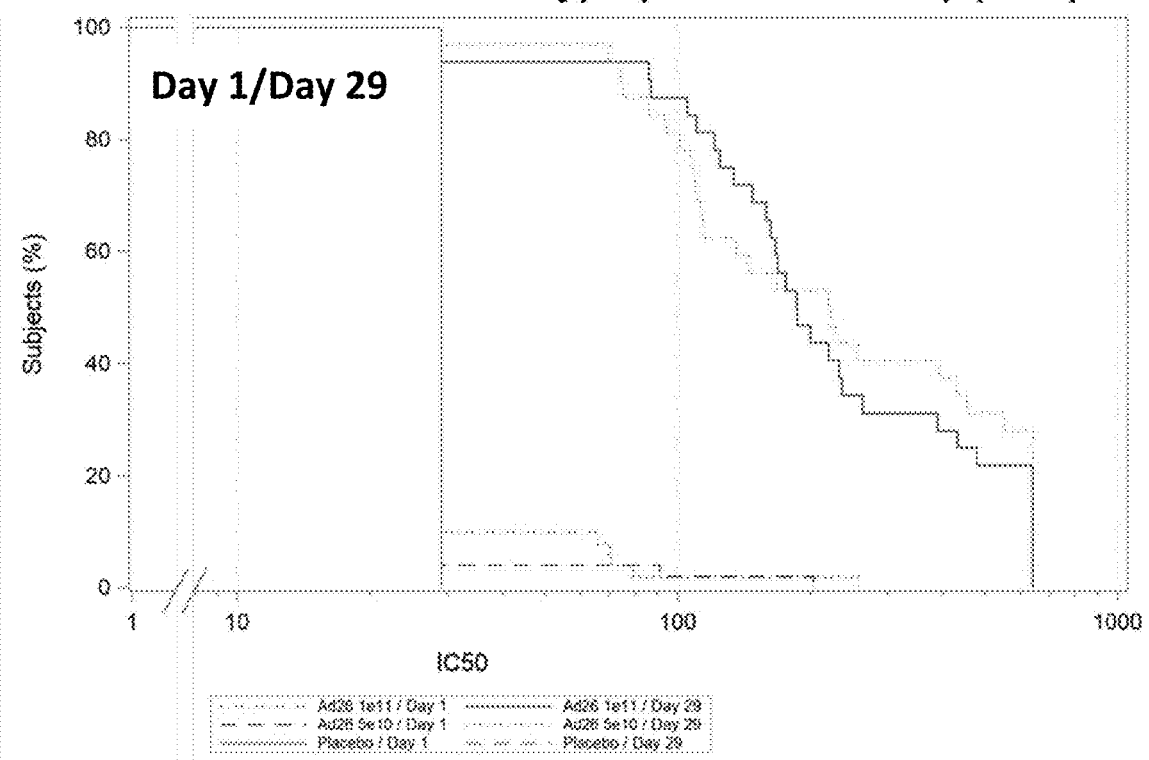
FIG. 107

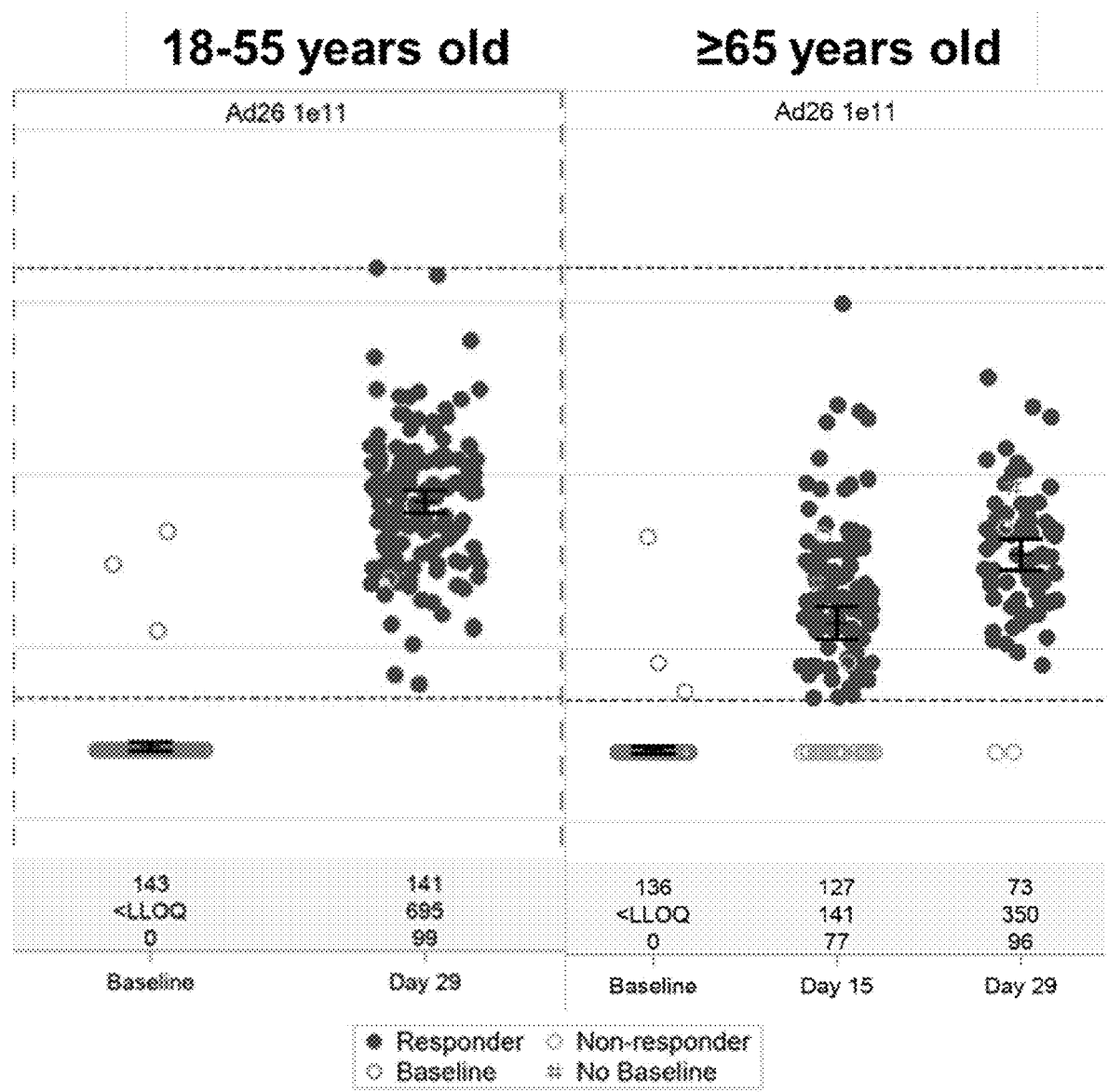
FIG. 109--Continued

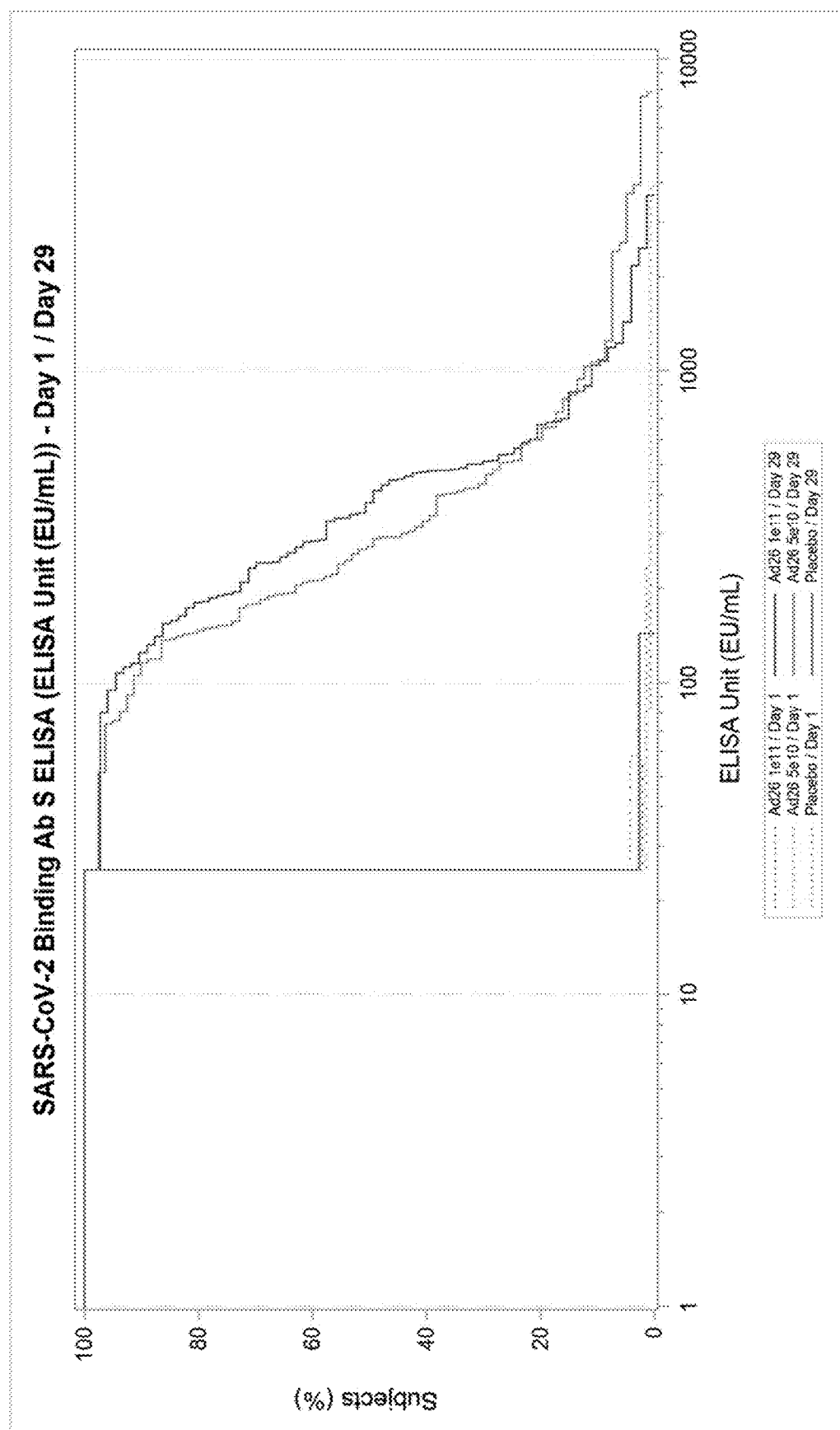
FIG. 111—Continued

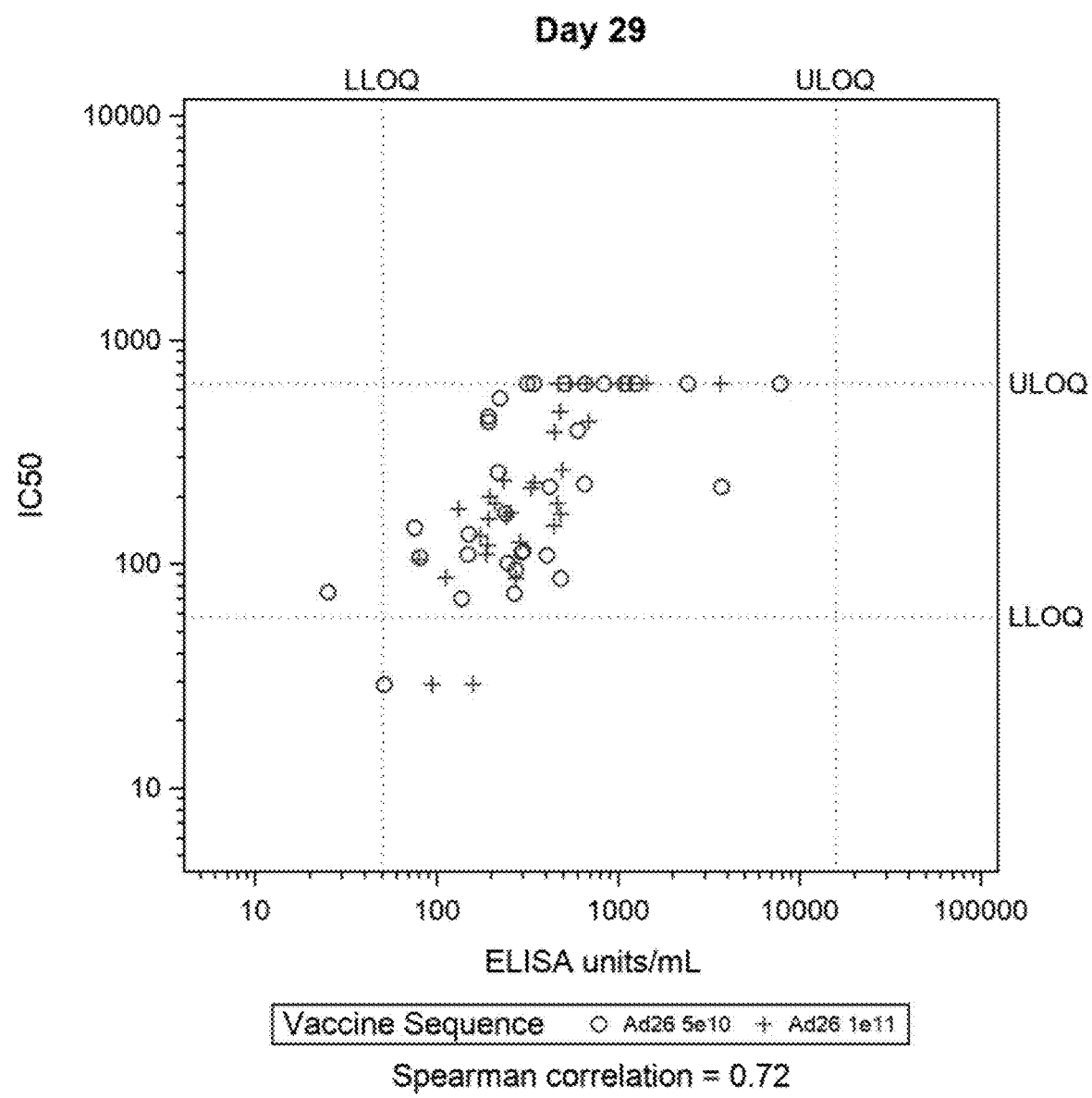
FIG. 112--Continued

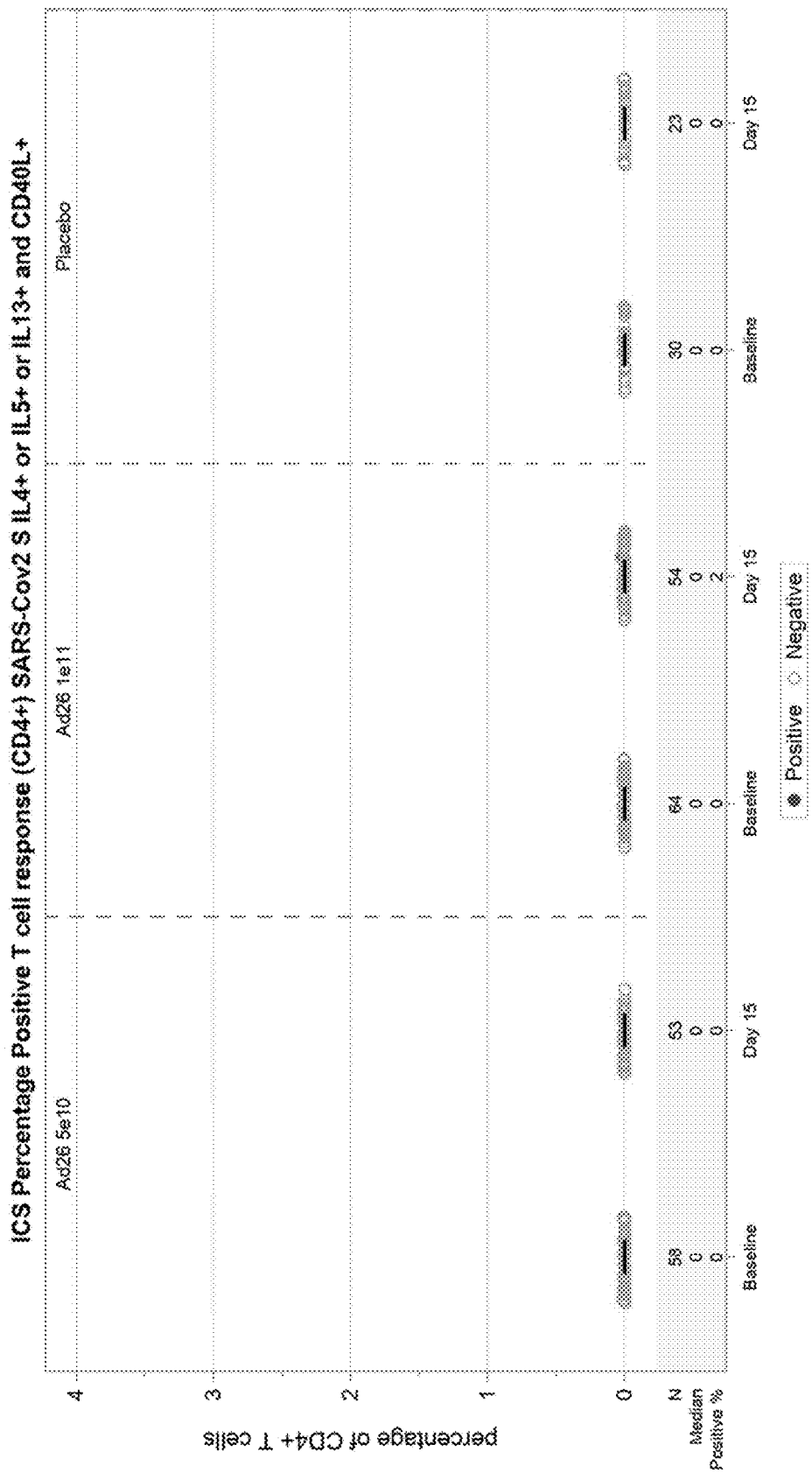
FIG. 113—Continued

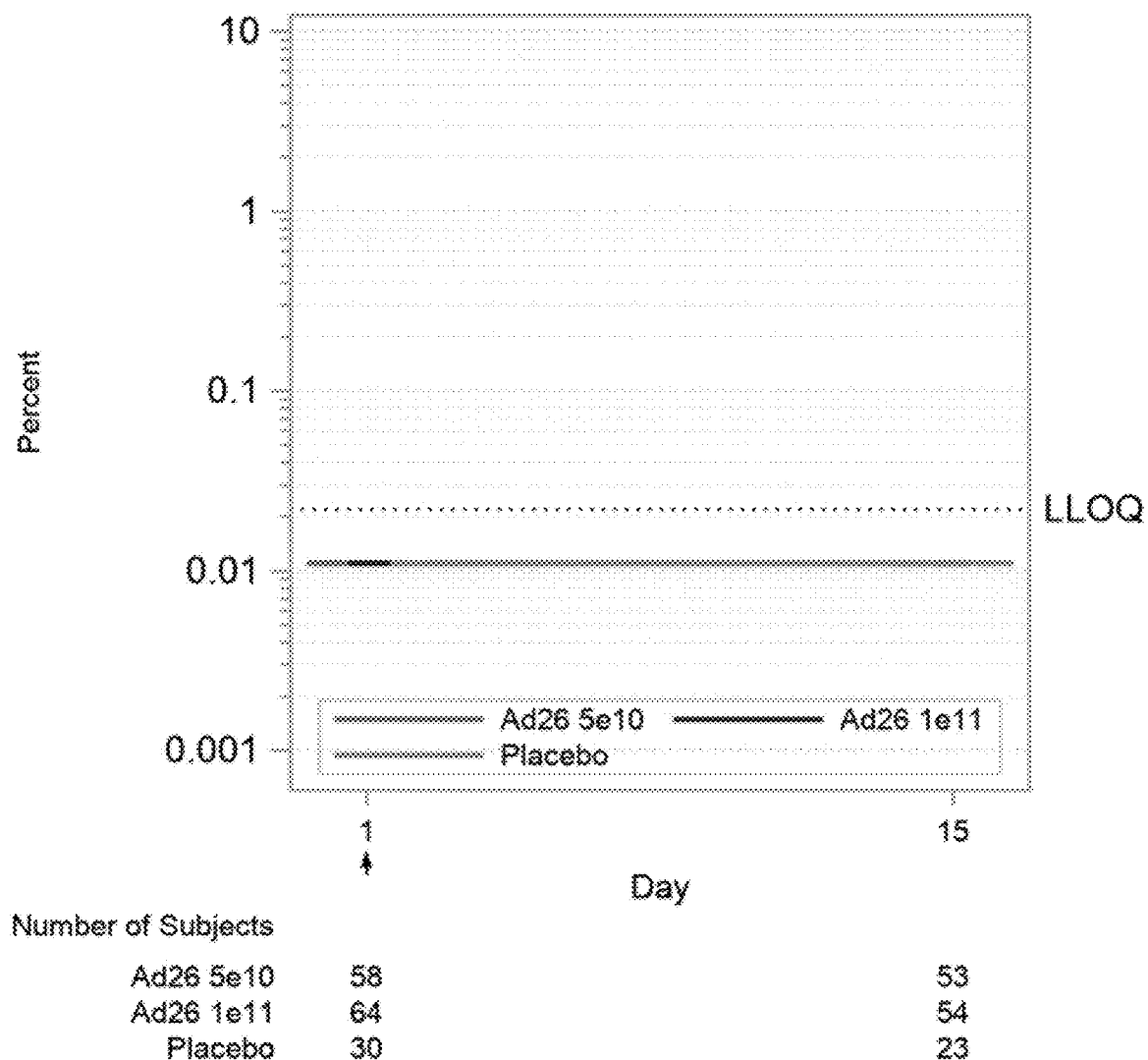
FIG. 114--Continued

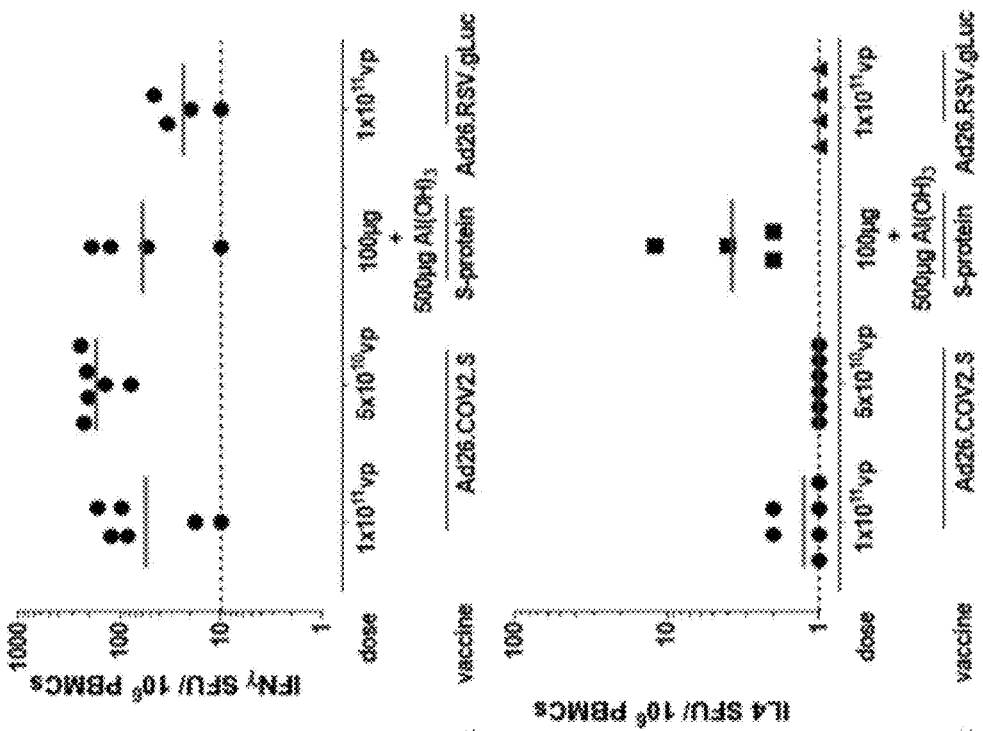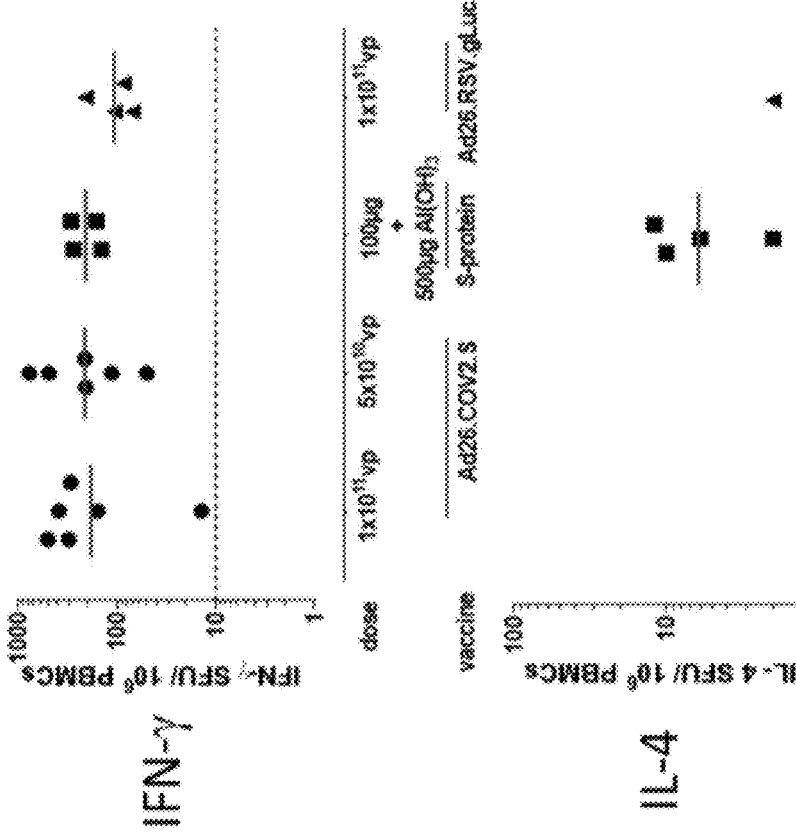
FIG. 119A

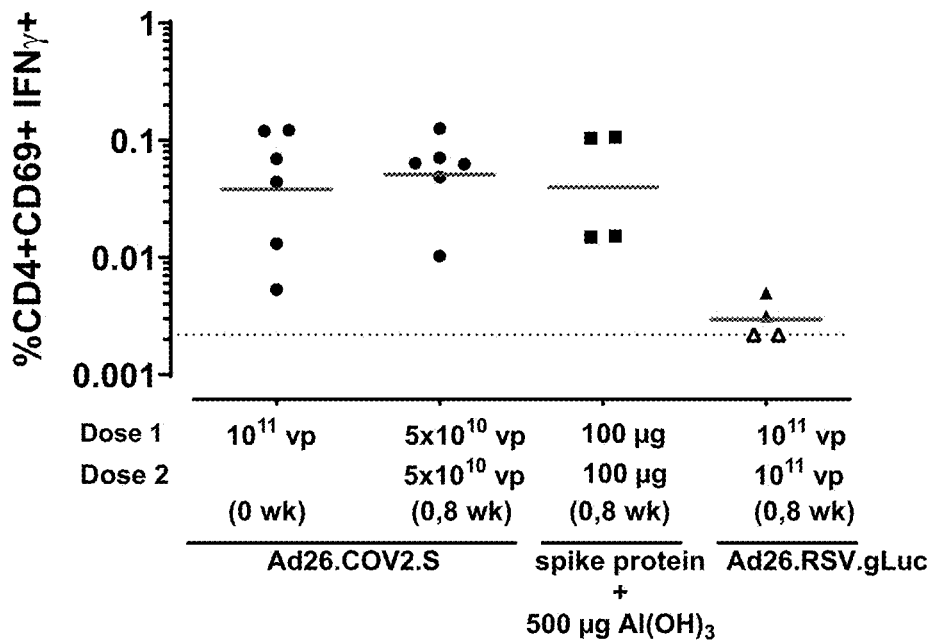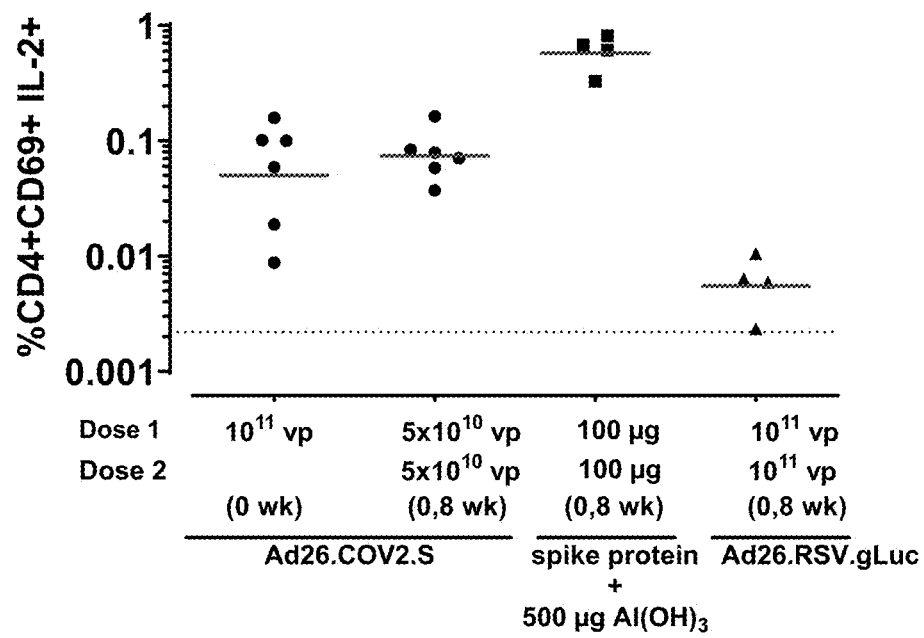
FIG. 119B

WEEK 4—IL-4
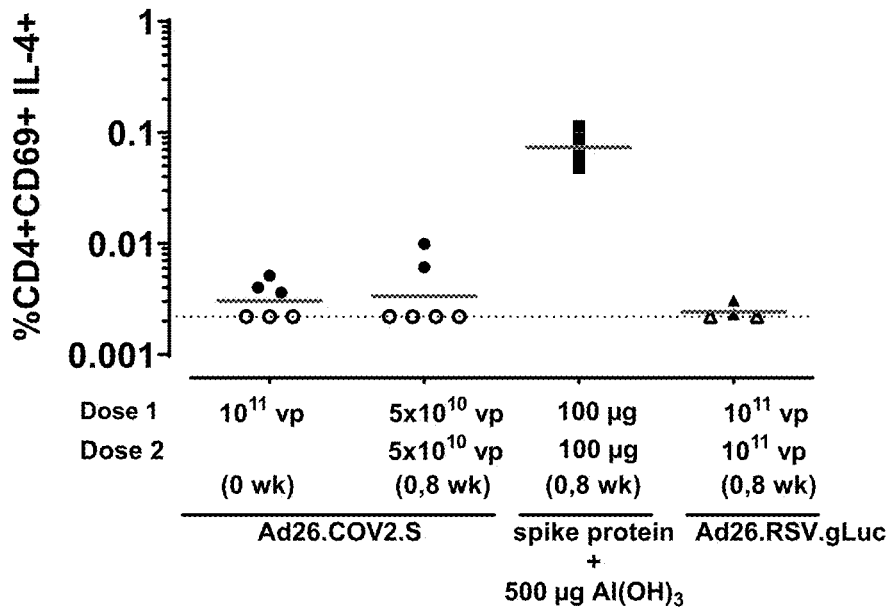
WEEK 4—IL-5
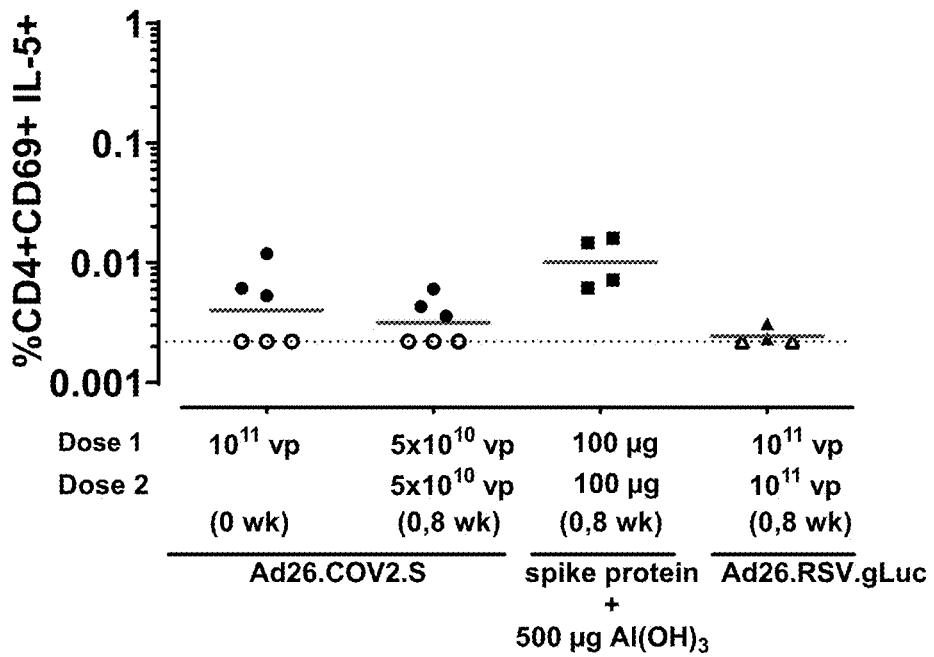
FIG.119B—Continued

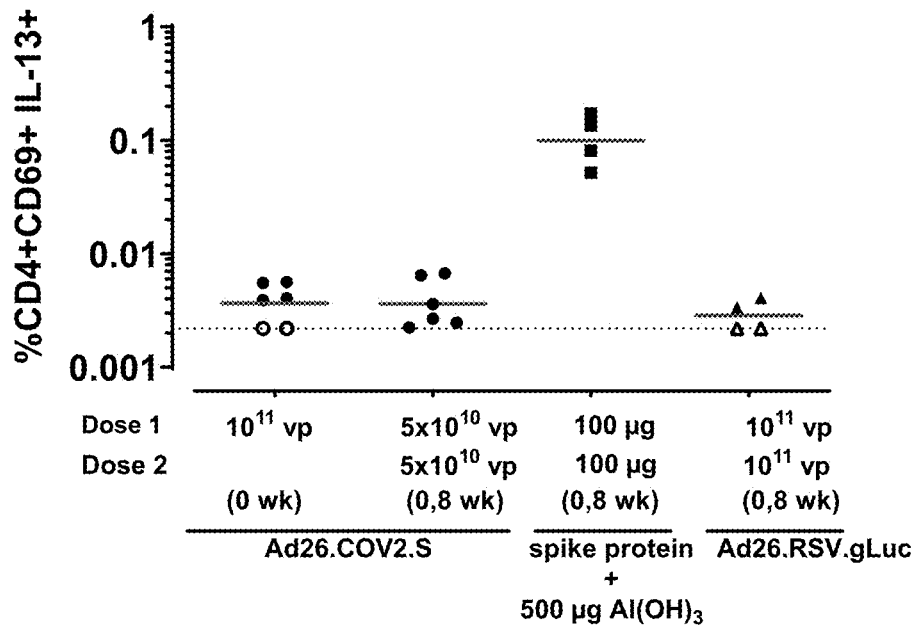
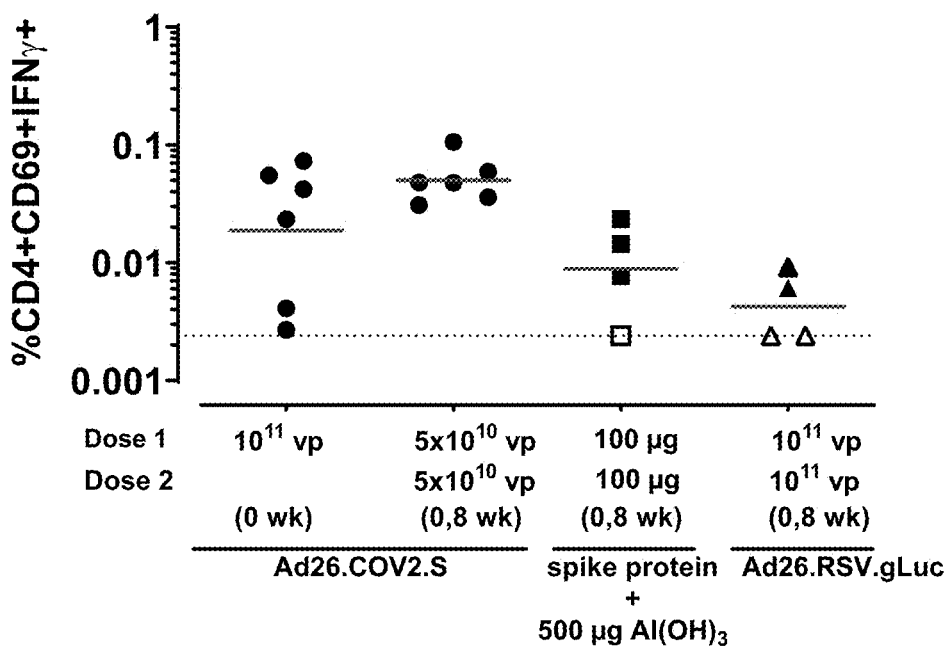
FIG. 119B—Continued

WEEK 10—IL-2
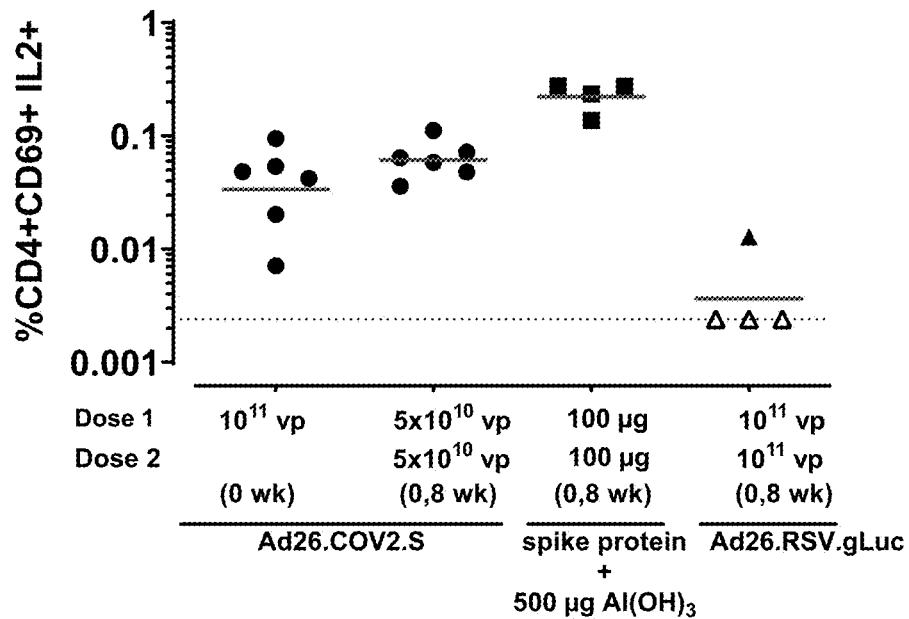
WEEK 10—IL-4
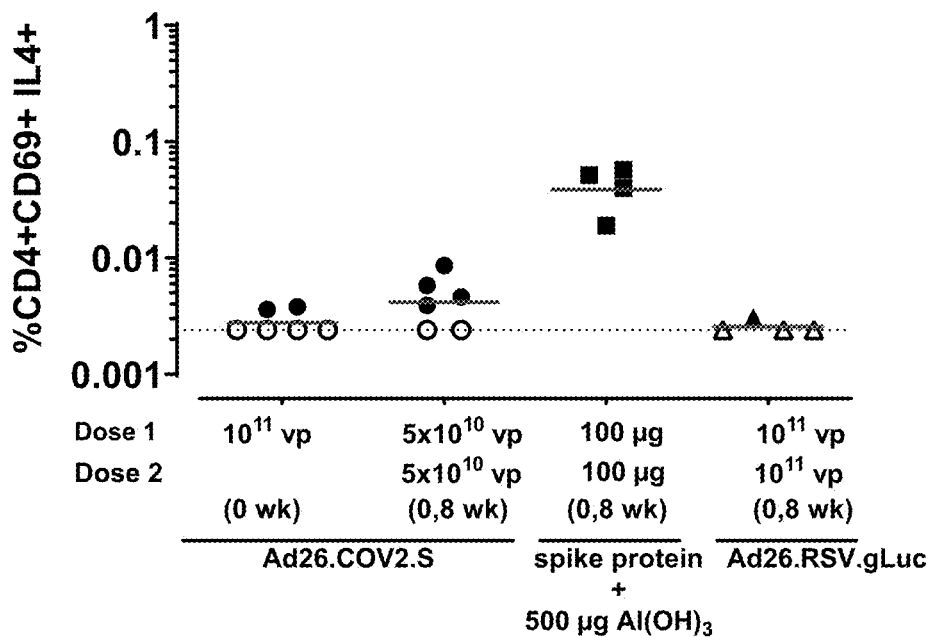
FIG. 119B—Continued

WEEK 10—IL-5
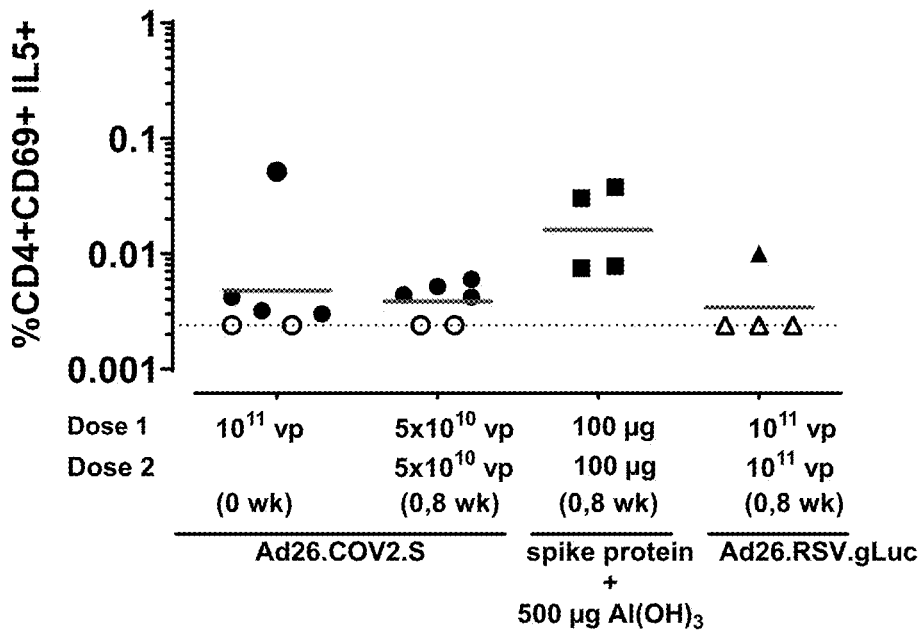
WEEK 10—IL-13
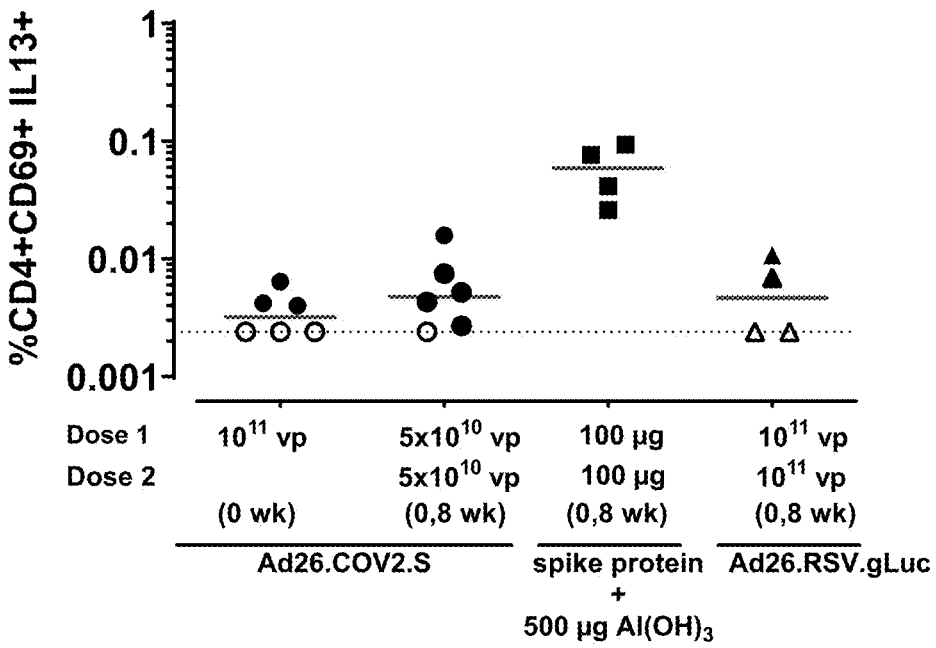
FIG. 119B—Continued

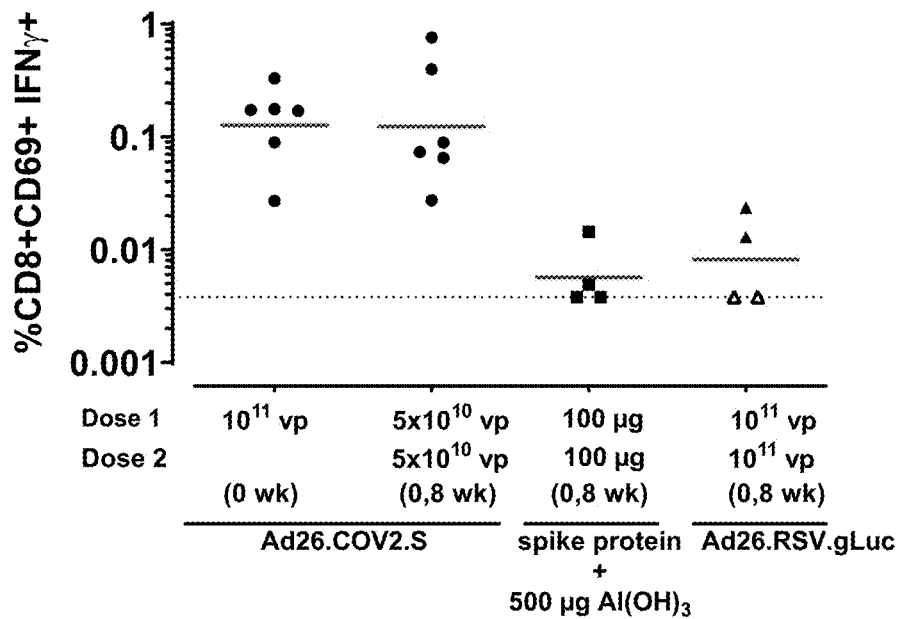
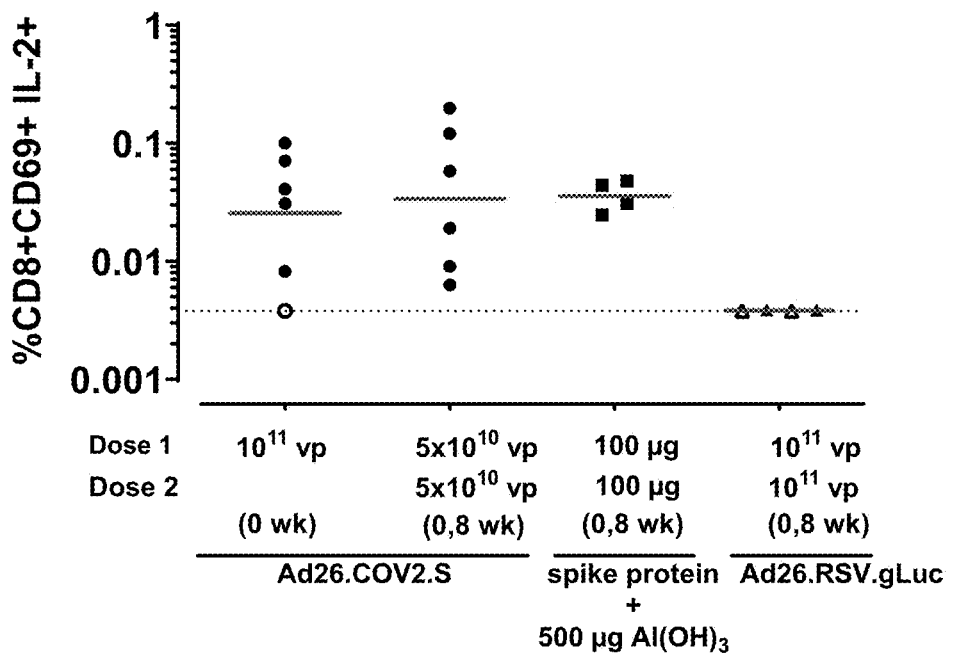
FIG. 120

WEEK 4—IL-4
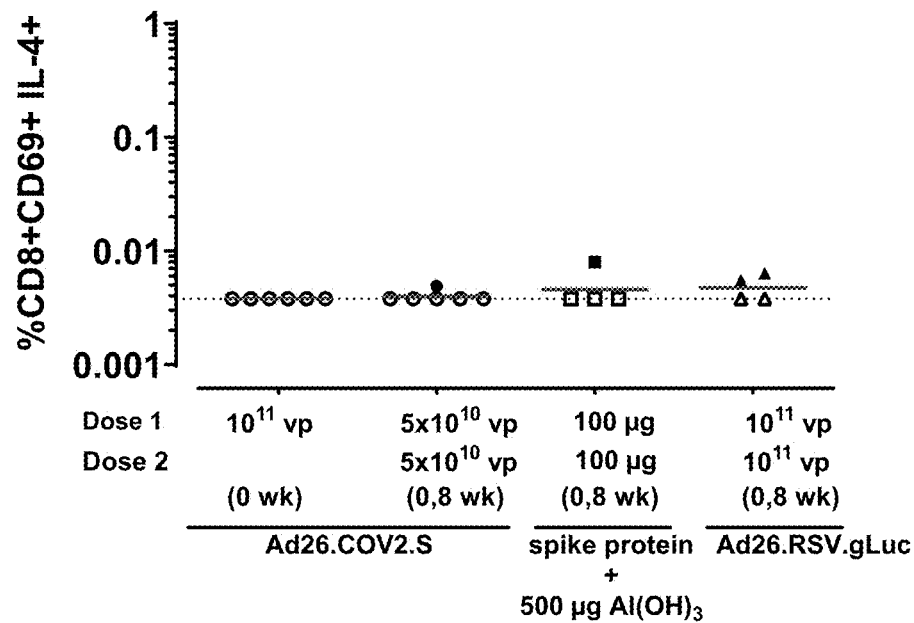
WEEK 4—IL-5
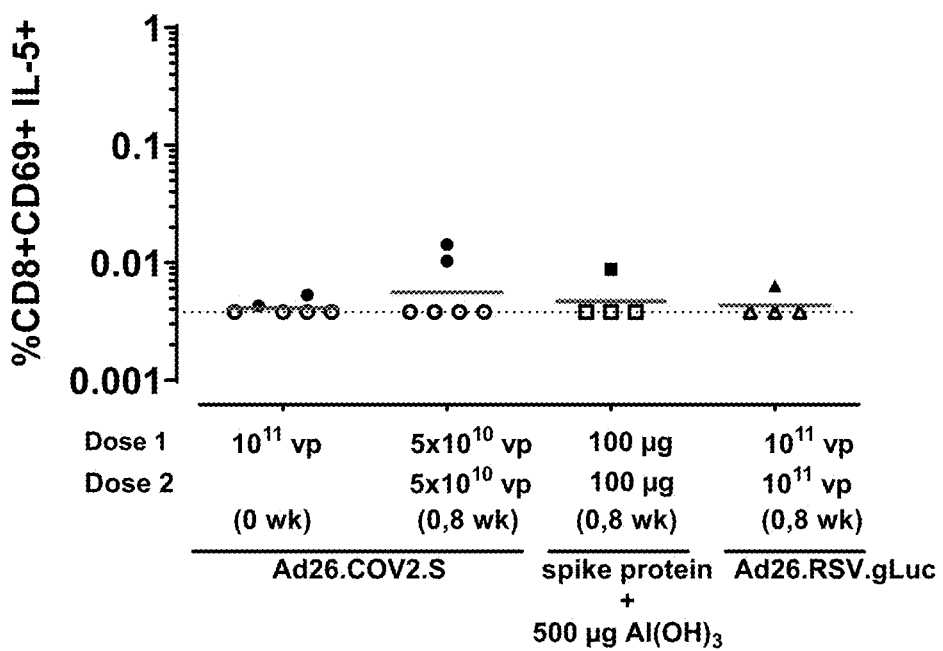
FIG. 120—Continued

WEEK 4—IL-13
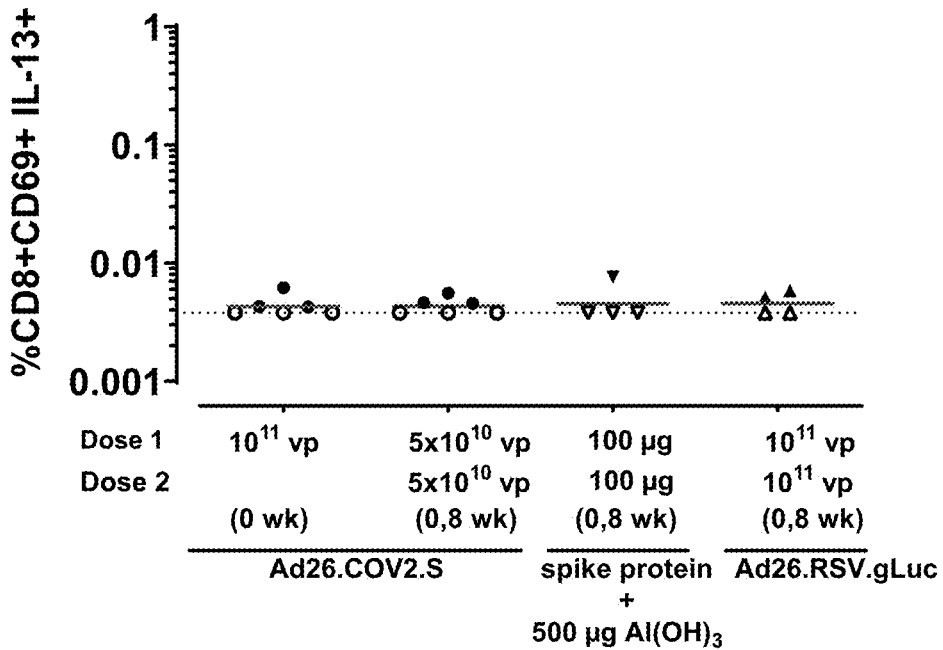
WEEK 10—IFNγ
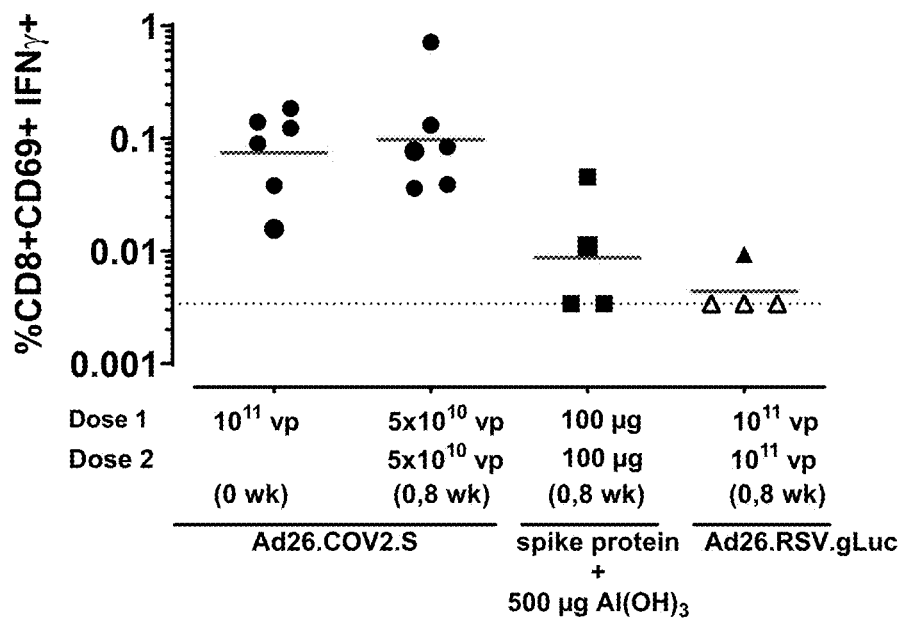
FIG. 120—Continued

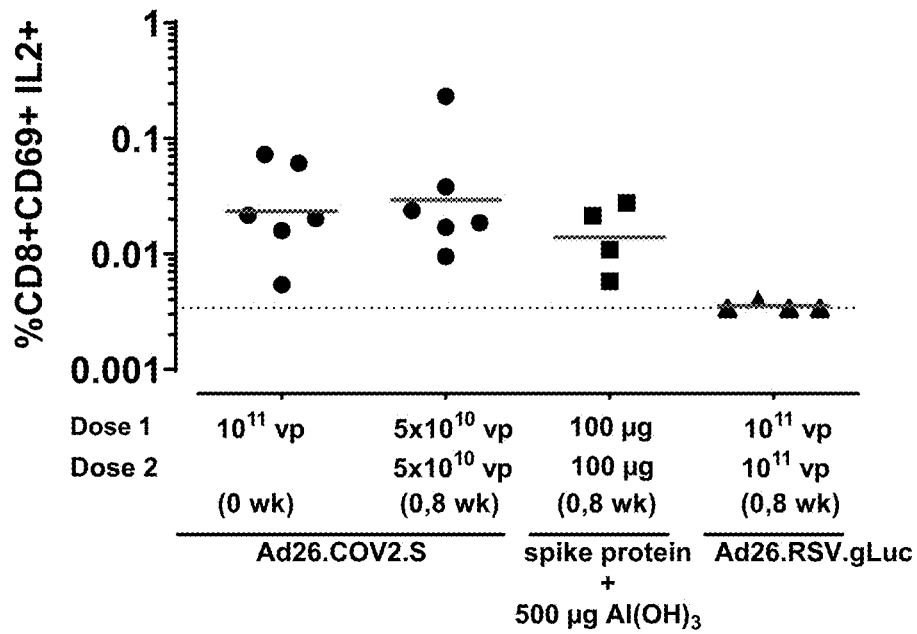
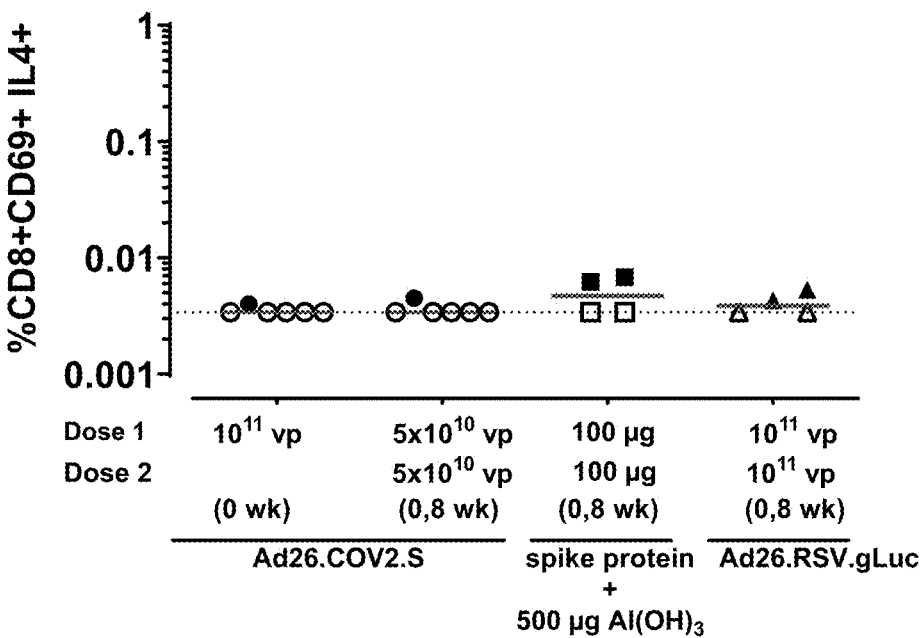
FIG. 120—Continued

WEEK 10—IL-5
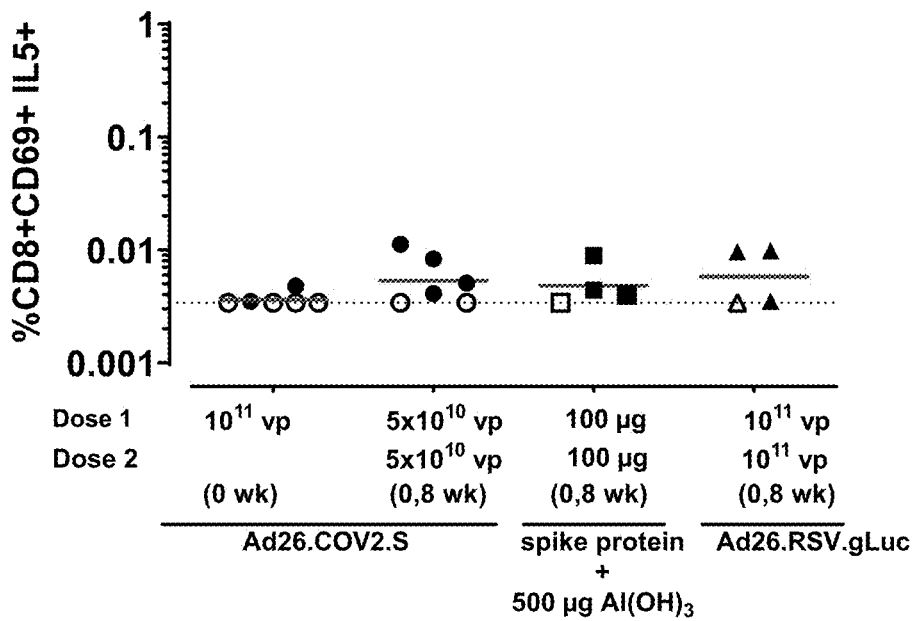
WEEK 10—IL-13
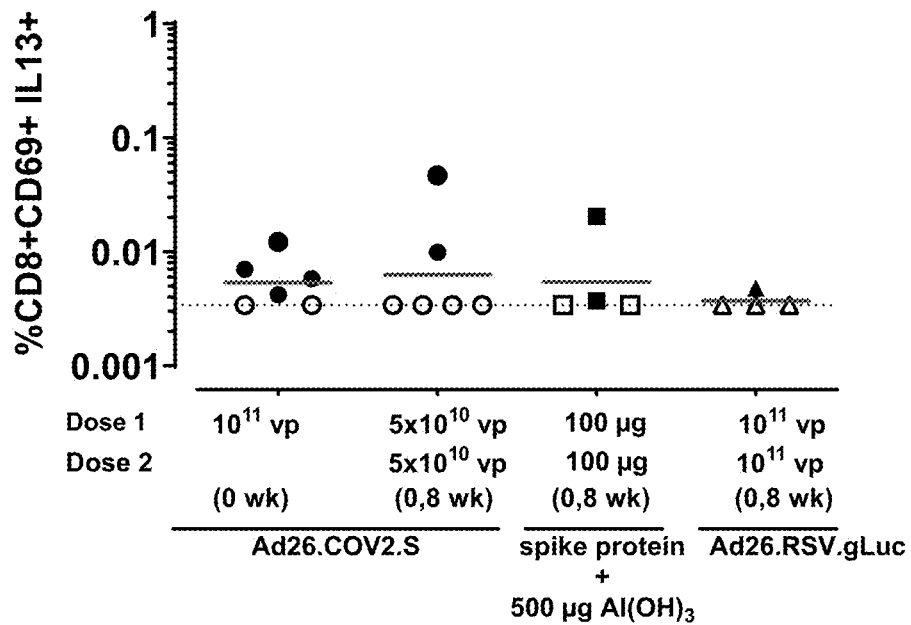
FIG. 120—Continued a) Binding antibodies b) nAbs c) Lung VL d) IHC lung parenchyma

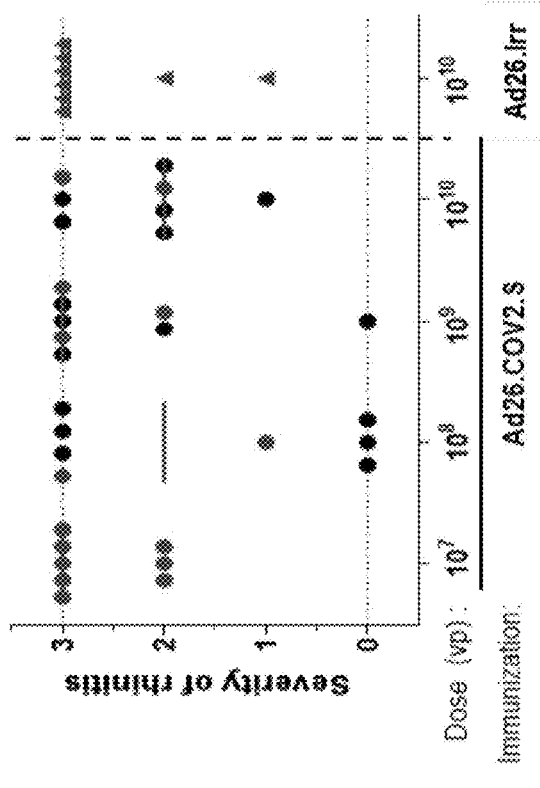
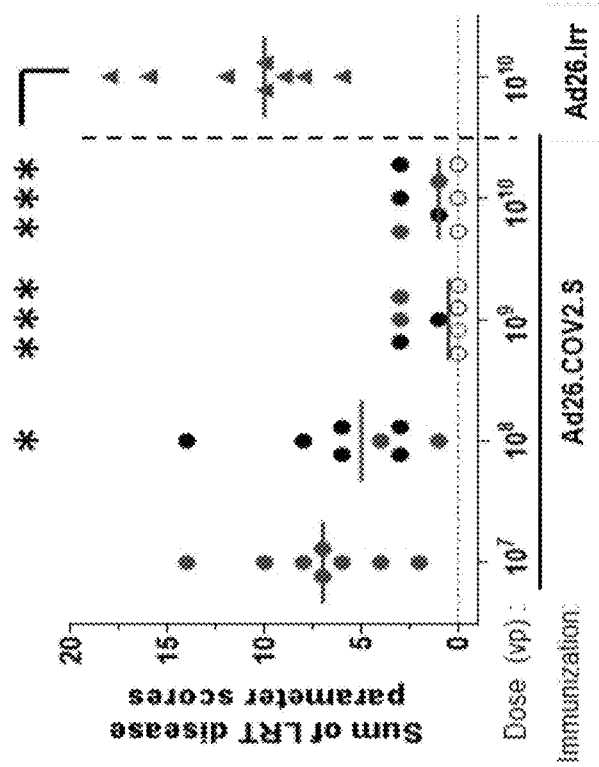
FIG. 134 c) Logistic regression lung VL vs wtVNA and ELISA in Ad26.COV2.S immunized hamsters

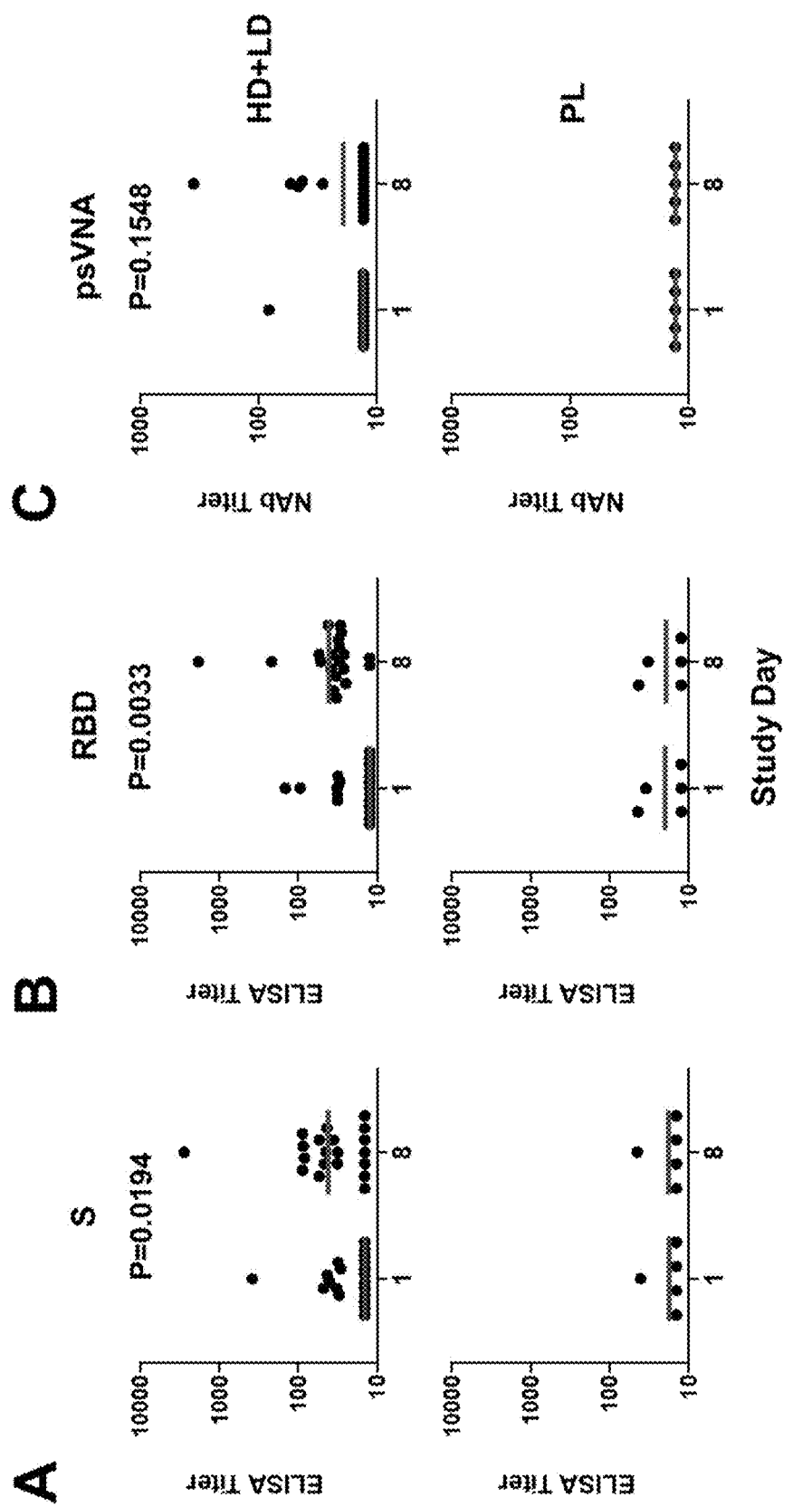
FIGs. 136A-C

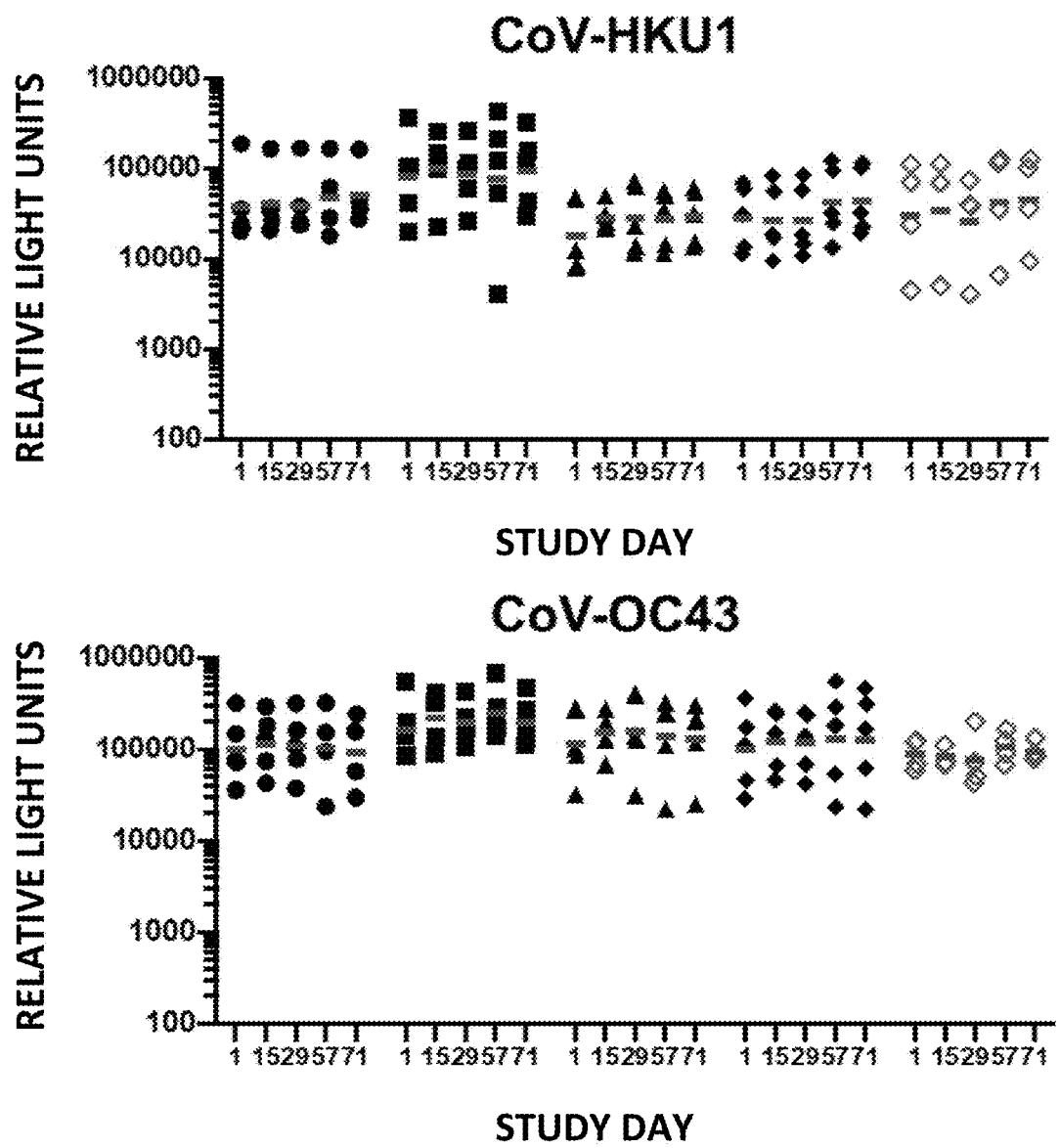
FIG. 139B—Continued

COMPOSITIONS AND METHODS FOR PREVENTING AND TREATING CORONAVIRUS INFECTION—SARS-COV-2 VACCINES

CROSS REFERENCE TO RELATED APPLICATIONS

This application is a continuation application of U.S. application Ser. No. 17/163,357, filed Jan. 30, 2021, which claims priority to U.S. Provisional Application No. 62/969,008, filed Jan. 31, 2020; U.S. Provisional Application No. 62/994,630, filed Mar. 25, 2020; U.S. Provisional Application No. 63/014,467, filed Apr. 23, 2020; U.S. Provisional Application No. 63/025,782, filed May 15, 2020; U.S. Provisional Application No. 62/705,187, filed Jun. 15, 2020; U.S. Provisional Application No. 62/705,308, filed Jun. 21, 2020; U.S. Provisional Application No. 63/043,090, filed Jun. 23, 2020; U.S. Provisional Application No. 62/706,366, filed Aug. 12, 2020; U.S. Provisional Application No. 63/066,147, filed Aug. 14, 2020; U.S. Provisional Application No. 62/706,676, filed Sep. 2, 2020; U.S. Provisional Application No. 62/706,937, filed Sep. 18, 2020; U.S. Provisional Application No. 62/706,958, filed Sep. 21, 2020; U.S. Provisional Application No. 63/198,089, filed Sep. 28, 2020; U.S. Provisional Application No. 63/198,306, filed Oct. 9, 2020; U.S. Provisional Application No. 63/112,900, filed on Nov. 12, 2020; Canadian Patent Application No. 3,101,131, filed Nov. 28, 2020; U.S. Provisional Application No. 63/121,482, filed Dec. 4, 2020; U.S. Provisional Application No. 63/133,969, filed Jan. 5, 2021; U.S. Provisional Application No. 63/135,182, filed Jan. 8, 2021; U.S. Provisional Application No. 63/141,913, filed Jan. 26, 2021; U.S. Provisional Application No. 63/142,977, filed Jan. 28, 2021. Each disclosure is incorporated by reference in its entirety.

STATEMENT AS TO FEDERALLY FUNDED RESEARCH

This invention was made with Government support under Agreement HHSO100201700018C, awarded by HHS. The Government has certain rights in the invention.

INTRODUCTION

The invention relates to the fields of virology and medicine. In particular, the invention relates to vaccines for the prevention of disease induced by SARS-CoV-2.

SEQUENCE LISTING

The instant application contains a Sequence Listing which has been submitted electronically in ASCII format and is hereby incorporated by reference in its entirety. The ASCII copy, created on Jul. 27, 2021, is named "004852_161US17_Sequence_Listing", and is 1,402 KB in size.

BACKGROUND

SARS-CoV-2 is a coronavirus that was first discovered late 2019 in the Wuhan region in China. SARS-CoV-2 is a beta-coronavirus, like MERS-CoV and SARS-CoV, all of which have their origin in bats. There are currently several sequences available from several patients from the U.S., China and other countries, suggesting a likely single, recent emergence of this virus from an animal reservoir. The name of this disease caused by the virus is coronavirus disease 2019, abbreviated as COVID-19. Symptoms of COVID-19 range from mild symptoms to severe illness and death for confirmed COVID-19 cases.

As indicated above, SARS-CoV-2 has strong genetic similarity to bat coronaviruses, from which it likely originated, although an intermediate reservoir host such as a pangolin is thought to be involved. From a taxonomic perspective SARS-CoV-2 is classified as a strain of the severe acute respiratory syndrome (SARS)-related coronavirus species.

Coronaviruses are enveloped RNA viruses. The major surface protein is the large, trimeric spike glycoprotein (S) that mediates binding to host cell receptors as well as fusion of viral and host cell membranes. The S protein is composed of an N-terminal S1 subunit and a C-terminal S2 subunit, responsible for receptor binding and membrane fusion, respectively. Recent cryo-EM reconstructions of the CoV trimeric S structures of alpha-, beta-, and deltacoronaviruses revealed that the S1 subunit comprises two distinct domains: an N-terminal domain (S1 NTD) and a receptor-binding domain (S1 RBD). SARS-CoV-2 makes use of its S1 RBD to bind to human angiotensin-converting enzyme 2 (ACE2).

The rapid expansion of the COVID-19 pandemic has made the development of a SARS-CoV-2 vaccine a global health priority. Since the novel SARS-CoV-2 virus was first observed in humans in late 2019, over 8 million people have been infected and hundreds of thousands have died as a result of COVID-19. SARS-CoV-2, and coronaviruses more generally, lack effective treatment, leading to a large unmet medical need. In addition, there is currently no vaccine available to prevent coronavirus induced disease (COVID-19). The best way to prevent illness currently is to avoid being exposed to this virus. Since emerging infectious diseases, such as COVID-19 present a major threat to public health there is an urgent need for novel vaccines that can be used to prevent coronavirus induced respiratory disease.

Wuhan coronavirus (2019-nCoV; also referred to as SARS-CoV-2) is a coronavirus that is responsible for an unprecedented current epidemic in China. 2019-nCoV is known to cause respiratory symptoms and fever, which may result in death.

The World Health Organization declared the 2019-nCoV outbreak a Public Health Emergency of International Concern on Jan. 30, 2020 and has confirmed over 11,000 cases in 16 countries. While the rapid development of a safe and effective 2019-nCoV vaccine is a global health priority, very little is currently known about 2019-nCoV immunology and mechanisms of immune protection.

Accordingly, there is an unmet need in the field for 2019-nCoV therapies.

SUMMARY OF THE INVENTION

In the research that led to the present invention certain stabilized SARS-CoV-2 S proteins were constructed that were demonstrated to be useful as immunogens for inducing a protective immune response against SARS-CoV-2.

The invention provides an isolated nucleic acid molecule comprising a nucleotide sequence that encodes a 2019-NCOV Spike (S) protein (also referred to as SARS-CoV-2 S protein herein) comprising the following modifications to the full-length amino acid sequence of SEQ ID NO: 29:
  a. stabilising mutations to proline at amino acids 986 and 987; and
  b. mutations to the furin cleavage site (SEQ ID NO: 90).

In some embodiments, these are the only modifications made to the sequence of SEQ ID NO: 29. In other embodiments, the isolated nucleic acid molecule encodes a 2019-NCOV Spike (S) protein that comprises the following further modification to the full-length amino acid sequence of SEQ ID NO: 29:
c. deletion of the signal sequence.

In some embodiments, the nucleic acid encoding the 2019-NCOV Spike (S) protein is operably linked to a cytomegalovirus (SEQ ID NO: 219) promoter, preferably the CMV immediate early promoter. In some embodiments, the nucleic acid encoding the 2019-NCOV Spike (S) protein is operably linked to a cytomegalovirus (CMV) promoter comprising at least one tetracycline operator (TetO) motif. In specific embodiments, the CMV promoter comprising at least one TetO motif comprises a nucleotide sequence of SEQ ID NO: 219. In some embodiments, the CMV promotor consists of the nucleotide sequence of SEQ ID NO: 219. These nucleic acids typically form part of a vector.

In one aspect, the present invention thus relates to isolated and/or recombinant nucleic acids encoding a stabilized coronavirus S protein, in particular a SARS-CoV-2 S protein, said nucleic acids comprising a nucleotide sequence selected from the group consisting of SEQ ID NO: 211-218, or fragments thereof.

In a preferred embodiment, the present invention relates to an isolated and/or recombinant nucleic acid encoding a stabilized coronavirus S protein, in particular a SARS-CoV-2 S protein, said nucleic acid comprising a nucleotide of SEQ ID NO: 211, or fragments thereof.

The invention provides an isolated 2019-NCOV Spike (S) protein (also referred to as SARS-CoV-2 S protein herein) comprising the following modifications to the full-length amino acid sequence of SEQ ID NO: 29:
a. stabilising mutations to proline at amino acids 986 and 987; and
b. mutations to the furin cleavage site (SEQ ID NO: 90).

In some embodiments, these are the only modifications made to the sequence of SEQ ID NO: 29. In other embodiments the isolated 2019-NCOV Spike (S) protein comprises the following further modification to the full-length amino acid sequence of SEQ ID NO: 29:
c. deletion of the signal sequence.

In another aspect the invention relates to isolated and/or recombinant coronavirus S proteins comprising an amino acid sequence selected from the group consisting of SEQ ID NO: 205-210, or fragments thereof, as well as to nucleic acids encoding such coronavirus S proteins, or fragments thereof.

In a preferred embodiment, the invention relates to an isolated and/or recombinant coronavirus S proteins comprising an amino acid sequence of SEQ ID NO: 205, or fragments thereof, as well as to nucleic acids encoding such coronavirus S proteins, or fragments thereof.

In yet another aspect, the invention relates to vectors comprising such nucleic acids. In certain embodiments, the vector is a recombinant human adenovirus of serotype 26.

In another aspect, the invention relates to compositions and vaccines comprising such nucleic acids, proteins and/or vectors.

In another aspect, the invention relates to methods for vaccinating a subject against COVID-19, the method comprising administering to the subject a vaccine or composition according to the invention.

In another aspect, the invention relates to an isolated host cell comprising a recombinant human adenovirus of serotype 26 comprising nucleic acid encoding a SARS-CoV-2 S protein or fragment thereof.

In another aspect, the invention relates to methods for making a vaccine against COVID-19, comprising providing a recombinant human adenovirus of serotype 26 that comprises nucleic acid encoding a SARS-CoV-2 S protein or fragment thereof, propagating said recombinant adenovirus in a culture of host cells, isolating and purifying the recombinant adenovirus, and formulating the recombinant adenovirus in a pharmaceutically acceptable composition. The recombinant human adenovirus of this aspect may be any of the adenoviruses described herein.

In another aspect, the invention relates to an isolated recombinant nucleic acid that forms the genome of a recombinant human adenovirus of serotype 26 that comprises a nucleic acid encoding a SARS-CoV-2 S protein or fragment thereof. The adenovirus may also be any of the adenoviruses as described in the embodiments above.

The invention also relates to a composition for use in prevention of molecularly confirmed, moderate to severe/critical COVID-19 in a subject in need thereof, comprising administering to the subject a composition or immunogenic composition of the invention as described herein, wherein the composition is administered at a dose of $5 \times 10^{10}$ vp per dose in a one dose regimen (i.e. a single dose).

The present invention features optimized and/or non-naturally occurring coronavirus (e.g., 2019-nCoV) nucleic acid molecules and polypeptides for the generation of DNA or RNA vaccines, antibodies, and immunogenic compositions and their use in methods of preventing, reducing and/or treating a coronavirus (e.g., 2019-nCoV) infection in a subject (e.g., a mammalian subject (e.g., a human)).

One aspect of the invention features an isolated nucleic acid molecule comprising a nucleotide sequence that encodes a polypeptide having at least 85% sequence identity to an amino acid sequence of any one of SEQ ID NOs: 1-84. In some embodiments, a) the polypeptide is capable of eliciting an immune response in a subject; or b) the polypeptide has at least 86, 87, 88, 89, 90, 91, 92, 93, 94, 95, 96, 97, 98, or 99% sequence identity to, or the polypeptide sequence of, any one of SEQ ID NOs: 1-84. In some embodiments, the polypeptide has the amino acid sequence of SEQ ID NO: 56. In some embodiments, the polypeptide has the amino acid sequence of SEQ ID NO: 51.

Another aspect features an isolated nucleic acid molecule comprising a nucleotide sequence having at least 85% sequence identity to all or a portion of any one of SEQ ID NOs: 93-181, 190-195, and 199-204, or a complementary sequence thereof. In some embodiments, the nucleic acid molecule has at least 86, 87, 88, 89, 90, 91, 92, 93, 94, 95, 96, 97, 98, or 99% sequence identity to, or the nucleotide sequence of, any one of SEQ ID NOs: 93-181, 190-195, and 199-204. In some embodiments, the nucleic acid molecule, or a portion thereof, is capable of eliciting an immune response in a subject. In some embodiments, the nucleic acid molecule has the nucleotide sequence of SEQ ID NO: 195. In some embodiments, the nucleic acid molecule has the nucleotide sequence of SEQ ID NO: 143. In some embodiments, the nucleic acid molecule has the nucleotide sequence of SEQ ID NO: 204. In some embodiments, the nucleic acid molecule has the nucleotide sequence of nucleotides 19-3837 of SEQ ID NO: 204. Another aspect features an isolated polypeptide comprising an amino acid sequence having at least 85% sequence identity to all or a portion of any one of SEQ ID NOs: 1-84. In some embodiments, said polypeptide has at least 86, 87, 88, 89, 90, 91, 92, 93, 94, 95, 96, 97, 98, or 99% sequence identity to, or the amino acid sequence of, any one of SEQ ID NOs: 1-84. In some embodiments, the polypeptide, or a portion thereof, is capable of eliciting an immune response in a subject. In some embodiments, the polypeptide has the amino acid sequence of SEQ ID NO: 28. In some embodiments, the polypeptide has the amino acid sequence of SEQ ID NO: 51.

Another aspect features an isolated vector comprising one or more of the above nucleic acid molecules. In some embodiments, the vector is replication-defective (e.g., lacking an E1, E3, and/or E4 region). In some embodiments, the vector is a mammalian, bacterial, or viral vector. In some embodiments, the vector is an expression vector. In some embodiments, the viral vector is a virus selected from the group consisting of a retrovirus, adenovirus, adeno-associated virus, parvovirus, coronavirus, negative strand RNA viruses, orthomyxovirus, rhabdovirus, paramyxovirus, positive strand RNA viruses, picornavirus, alphavirus, double stranded DNA viruses, herpesvirus, Epstein-Barr virus, cytomegalovirus, fowlpox, and canarypox. In some embodiments, the vector is an adenovirus. In some embodiments, the adenovirus is selected from the group consisting of Ad2, Ad5, Ad11, Ad12, Ad24, Ad26, Ad34, Ad35, Ad40, Ad48, Ad49, Ad50, Ad52, Ad59, and Pan9. In some embodiments, the Ad52 is a rhesus Ad52 or the Ad59 is a rhesus Ad59. In some embodiments, the adenovirus is Ad26. In other embodiments, the adenovirus is an Ad26 vector that comprises a nucleic acid molecule with nucleotides 19-3837 of SEQ ID NO: 204 or all of the nucleotides of SEQ ID NO: 204. In another embodiment, the adenovirus is an Ad26 vector that comprises a nucleic acid molecule encoding a polypeptide with at least 85% or more (e.g., 90%, 95%, 99%, or 100%) sequence identity to the polypeptide of SEQ ID NOL 51.

Another aspect features an isolated antibody that specifically binds to any of the abovementioned polypeptides. In some embodiments, the antibody is generated by immunizing a mammal with the nucleic acid, the polypeptide, or the vector. In some embodiments, the mammal is a human, cow, goat, mouse, or rabbit. In some embodiments, the antibody is humanized. In some embodiments, the antibody is an IgG. In some embodiments, the antibody is a bis-Fab, Fv, Fab, Fab'-SH, F(ab)$_2$, a diabody, a linear antibody, or a scFV.

Another aspect features a method of producing an anti-2019-Wuhan coronavirus (2019-nCoV) antibody, comprising administering an amount of the nucleic acid molecule, the polypeptide, and/or the vector to a subject sufficient to elicit the production of neutralizing anti-2019-nCoV antisera after administration to said subject.

Another aspect features an isolated anti-2019-nCoV antibody produced by any of the abovementioned methods. In some embodiments, the antibody binds to an epitope within any one of SEQ ID NOs: 1-84.

Another aspect features a composition comprising the nucleic acid molecule, the polypeptide, the vectors or the antibody. In some embodiments, the composition further comprises a pharmaceutically acceptable carrier, excipient, or diluent. In some embodiments, the composition further comprises an adjuvant or an immunostimulatory agent.

Another aspect features an immunogenic composition comprising the nucleic acid molecule, the polypeptide, the vector, or the antibody. In some embodiments, the immunogenic composition is a vaccine. In some embodiments, the immunogenic composition is capable of treating or reducing the risk of a coronavirus infection (e.g., a 2019-nCoV infection) in a subject in need thereof. In some embodiments, the immunogenic composition elicits production of neutralizing anti-2019-nCoV antisera after administration to said subject. In some embodiments, the subject is a mammal. In some embodiments, the mammal is a human. In some embodiments, the human has an underlying health condition. In some embodiments, the underlying health condition is hypertension, diabetes, or cardiovascular disease.

Another aspect features a method of identifying, diagnosing, and/or predicting the susceptibility of a subject to a coronavirus infection comprising determining whether the subject has a protective level of an anti-coronavirus antibody (such as an anti-Spike antibody) in a sample from the subject, wherein preferably the protective level is: (i) a level that is at or above a titer of at least about 70, as determined using a pseudovirus neutralization assay; (ii) a level that is at or above a titer of at least about 25, as determined using a live virus neutralization assay; or (iii) a level that is at least 80% of a median level of an anti-coronavirus antibody in a cohort of convalescent humans, as determined by a pseudovirus neutralization assay or live virus neutralization assay. In some embodiments the protective level of an anti-coronavirus antibody is a level sufficient to prevent or reduce the development of severe disease. In some embodiments, the method further comprises administering an effective amount of the composition or the immunogenic composition to the subject having less than a protective level of the anti-coronavirus antibody. In some embodiments, the method further comprises identifying a subclass and/or an effector function of the anti-coronavirus antibody (e.g., the anti-Spike antibody). In some embodiments, the subclass is IgM, IgA, IgG1, IgG2, IgG3, or FcgR2A. In some embodiments, the effector function is antibody-dependent neutrophil phagocytosis (ADNP), antibody-dependent complement deposition (ADCD), antibody-dependent monocyte cellular phagocytosis (ADCP), or antibody-dependent NK cell activation. In some embodiments, the sample is a bodily fluid from the subject, wherein preferably the bodily fluid is blood. In some embodiments, the coronavirus is 2019-nCoV.

Another aspect features a method of treating or reducing the risk of a coronavirus infection in a subject in need thereof, comprising administering a therapeutically effective amount of the composition or the immunogenic composition to said subject. In some embodiments, the method further comprises measuring an anti-coronavirus antibody (e.g., an anti-Spike antibody) level in the subject. In some embodiments, the anti-coronavirus antibody level in the subject is measured before and/or after the administration. In some embodiments, the anti-coronavirus antibody level in the subject is measured one or more times over about 1, 2, 3, 4, 5, or 6 days, 1, 2, 3, 4, 5, 6, or 7 weeks, 2, 3, 4, 5, or 6 months, 1, 2, 3, 4, or 5 years after administration. In some embodiments, the anti-coronavirus antibody level of the subject is below a protective level and wherein the method further comprises re-administering the composition or the immunogenic composition or administering a different anti-coronavirus composition to the subject. In some embodiments, the protective level is a level sufficient to reduce symptoms or duration of a coronavirus-mediated disease. In some embodiments, the protective level is a level sufficient to prevent or reduce the development of severe disease (e.g., which can be characterized by weight loss (e.g., a weight reduction of at least about 5% (e.g., at least about 7.5%, at least about 10%, at least about 12.5%, at least about 15%, at least about 20%, at least about 25% or more) relative to the subject's initial weight pre-infection), the development of pneumonia and/or respiratory failure, and/or increased risk of death). In some embodiments, the protective level is: (i)

a level that is at or above a titer of at least about 70, as determined using a pseudovirus neutralization assay; (ii) a level that is at or above a titer of at least about 25, as determined using a live virus neutralization assay; or (iii) a level that is at least 80% of a median level of an anti-coronavirus antibody in a cohort of convalescent humans, as determined by a pseudovirus neutralization assay or live virus neutralization assay. In some embodiments, the coronavirus is 2019-nCoV. In some embodiments, the method further includes measuring the coronavirus (e.g., 2019-nCoV) viral load in a sample from the subject. In some embodiments, the sample is a bronchoalveolar lavage (BAL) or a nasal swab (NS). In some embodiments, the sample is a bodily fluid (e.g., blood, e.g., whole blood or plasma) from the subject. In some embodiments, the sample is a tissue sample (e.g., a respiratory tract tissue sample) from the subject. In some embodiments, viral load is a detectible nucleic acid (e.g., subgenomic mRNA) level or a detectible protein (e.g., nucleocapsid protein (N)) level. In some embodiments, the detectible nucleic acid (e.g., subgenomic mRNA) is determined by RNA-seq, RT-qPCR, qPCR, multiplex qPCR or RT-qPCR, LAMP, microarray analysis, or hybridization (e.g., ISH (e.g., FISH)). In some embodiments, the detectible protein (e.g., nucleocapsid protein (N)) is determined by an immunoassay (e.g., an immunohistochemical (IHC) assay or a lateral flow immunoassay). In some embodiments, a detectable viral load indicates that the subject is susceptible to disease (e.g., a 2019-nCoV-mediated disease, e.g., COVID-19, e.g., severe COVID-19 disease). In some embodiments, a viral load of greater than at least about 3.5 $\log_{10}$ sgmRNA copies/mL. In some embodiments, a viral load of greater than 3.85 $\log_{10}$ sgmRNA copies/mL in BAL or 3.78 $\log_{10}$ sgmRNA copies/mL in NS indicates that the subject is susceptible to disease (e.g., a 2019-nCoV-mediated disease, e.g., COVID-19, e.g., severe COVID-19 disease). In some embodiments, a viral load of greater than 3.85 $\log_{10}$ sgmRNA copies/mL in BAL or 3.78 $\log_{10}$ sgmRNA copies/mL in NS indicates that the subject is susceptible to severe COVID-19 disease. In some embodiments, a viral load of greater than about 2.0 $\log_{10}$ sgmRNA copies/g of tissue indicates that the subject is susceptible to severe COVID-19 disease. In some embodiments, a viral load of greater than about 8.0 $\log_{10}$ sgmRNA copies/g in lung tissue, about 7.0 $\log_{10}$ sgmRNA copies/g in nares tissue, about 6.0 $\log_{10}$ sgmRNA copies/g in trachea tissue, about 5.5 $\log_{10}$ sgmRNA copies/g in heart tissue, or about 2.0 $\log_{10}$ sgmRNA copies/g in GI, spleen, liver, kidney, or brain tissue indicates that the subject is susceptible to severe COVID-19 disease. In some embodiments, a viral load of greater than about 3% SARS-CoV-2 vRNA staining by ISH indicates that the subject is susceptible to disease. In some embodiments, a viral load of greater than about 5% SARS-CoV-2 vRNA staining by ISH indicates that the subject is susceptible to severe COVID-19 disease. In some embodiments, coronavirus (e.g., 2019-nCoV) viral load is measured one or more times over about 1, 2, 3, 4, 5, or 6 days or 1, 2, 3, 4, 5, 6, or 7 weeks post-infection. In some embodiments, a subject determined to be susceptible to disease (e.g., a 2019-nCoV-mediated disease, e.g., COVID-19, e.g., severe COVID-19 disease) is administered the composition or the immunogenic composition of the present disclosure alone or in combination with an additional therapeutic agent.

Another aspect features a method of reducing a coronavirus-mediated activity (e.g., 2019-nCoV-mediated activity) in a subject infected with a 2019-nCoV, comprising administering a therapeutically effective amount of the composition or the immunogenic composition to said subject. In some embodiments, the therapeutically effective amount is sufficient to produce a log serum anti-Spike antibody titer greater than 2 in a subject, as measured by an ELISA assay.

In some embodiments, the therapeutically effective amount is between 15 μg and 300 μg of the composition or the immunogenic composition. In some embodiments, the activity is viral titer, viral spread, infection, or cell fusion. In some embodiments, the viral titer is decreased after administration of the composition or the immunogenic composition. In some embodiments, the viral titer is decreased by 25% or more. In some embodiments, the viral titer is decreased by 50% or more. In some embodiments, the viral titer is decreased by 75% or more. In some embodiments, the coronavirus is undetectable after said administration. In some embodiments, the administering occurs prior to exposure to the coronavirus. In some embodiments, the administering occurs at least 1 hour prior to exposure to said coronavirus. In some embodiments, the administering occurs at least 1 week, 1 month, or a year prior to exposure to said coronavirus. In some embodiments, the administering occurs post-exposure to the coronavirus. In some embodiments, the administering occurs at least 15 minutes post-exposure to said coronavirus. In some embodiments, the administering occurs at least 1 hour, 1 day, 1-week, post-exposure to said coronavirus. In some embodiments, the subject is administered at least one dose of the nucleic acid molecule, polypeptide, vector, composition, immunogenic composition, and antibody. In some embodiments, the subject is administered at least two doses. In some embodiments, the nucleic acid molecule, polypeptide, vector, composition, or immunogenic composition is administered to said subject as a prime, a boost, or as a prime boost. In some embodiments, the nucleic acid molecule, polypeptide, vector, composition, immunogenic composition, or antibody is administered intramuscularly, intravenously, intradermally, percutaneously, intraarterially, intraperitoneally, intralesionally, intracranially, intraarticularly, intraprostatically, intrapleurally, intratracheally, intranasally, intravitreally, intravaginally, intrarectally, topically, intratumorally, peritoneally, subcutaneously, subconjunctivelly, intravesicularlly, mucosally, intrapericardially, intraumbilically, intraocularly, orally, topically, locally, by inhalation, by injection, by infusion, by continuous infusion, by localized perfusion bathing target cells directly, by catheter, by lavage, by gavage, in creams, or in lipid compositions. In some embodiments, the nucleic acid molecule, polypeptide, vector, composition, immunogenic composition, or antibody is administered intramuscularly. In some embodiments, the subject is a mammal. In some embodiments, the mammal is a human. In some embodiments, the human has an underlying health condition. In some embodiments, the underlying health condition is hypertension, diabetes, or cardiovascular disease. In some embodiments, the method promotes an immune response in said subject. In some embodiments, the immune response is a humoral immune response. In some embodiments, the humoral immune response is an IgG response.

Another aspect features a composition for use in treating or reducing the risk of a coronavirus infection, such as a 2019-nCoV infection, in a subject in need thereof, comprising a therapeutically effective amount of the composition or the immunogenic composition. Another aspect features a composition for use in reducing a coronavirus-mediated activity (e.g., 2019-nCoV-mediated activity) in a subject infected with a 2019-nCoV, comprising a therapeutically effective amount of the composition or the immunogenic composition.

Another aspect features a method of manufacturing an immunogenic composition for treating or reducing the risk of a coronavirus (e.g., 2019-nCoV) infection in a subject in need thereof, said method comprising the steps of: (a) admixing at least one of the nucleic acid molecule, the polypeptide, the vector, the composition, and the antibody with a pharmaceutically acceptable carrier, excipient, or diluent to form the immunogenic composition; and (b) placing the immunogenic composition in a container.

Another aspect features a kit comprising: (a) a first container comprising at least one of the nucleic acid molecule, the polypeptide, the vector, the composition, the immunogenic composition, and the antibody; (b) instructions for use thereof; and optionally (c) a second container comprising a pharmaceutically acceptable carrier, excipient, or diluent. In some embodiments, the first container further comprises a pharmaceutically acceptable carrier, excipient, or diluent. The kit optionally includes an adjuvant and/or an immunostimulatory agent.

Another aspect features a kit comprising: one or more reagents for determining the presence of an anti-coronavirus antibody (such as an anti-Spike antibody) in a sample (e.g., a blood sample) from a subject and instructions for identifying, diagnosing, and/or predicting the susceptibility of a subject to a coronavirus infection. In some embodiments, the kit further comprises reagents for identifying a subclass and/or an effector function of the anti-coronavirus antibody. In some embodiments, the kit further comprises standards or samples for comparison.

BRIEF DESCRIPTION OF THE DRAWINGS

The accompanying drawings are included to illustrate embodiments of the invention and further an understanding of its implementations. The foregoing summary, as well as the following detailed description of the invention, will be better understood when read in conjunction with the appended drawings. It should be understood that the invention is not limited to the precise embodiments shown in the drawings.

(FIG. 6D) Comparison of pseudovirus neutralization titers in vaccinated macaques (all animals and SS-Spike/SS-SdCT groups), a cohort of 9 convalescent macaques, and a cohort of 27 convalescent humans from Boston who had recovered from 2019-nCoV infection. (FIG. 6E) S- and RBD-specific antibody-dependent neutrophil phagocytosis (ADNP), antibody-dependent complement deposition (ADCD), antibody-dependent monocyte cellular phagocytosis (ADCP), and antibody-dependent NK cell activation (IFN-γ secretion, CD107a degranulation, and MIP-1β expression) are shown. Radar plots show the distribution of antibody features across the vaccine groups. The size and color intensity of the wedges indicate the median of the feature for the corresponding group (blue depicts antibody functions, red depicts antibody isotype/subclass/FcγR binding). The principal component analysis (PCA) plot shows the multivariate antibody profiles across groups. Each dot represents an animal, the color of the dot denotes the group, and the ellipses shows the distribution of the groups as 70% confidence levels assuming a multivariate normal distribution. Red bars reflect median responses. Dotted lines reflect assay limit of detection.

(FIG. 8A) $Log_{10}$ sgmRNA copies/mL or copies/swab (limit 50 copies/mL) were assessed in bronchoalveolar lavage (BAL) and nasal swabs (NS) in sham controls at multiple timepoints following challenge. (FIG. 8B) $Log_{10}$ sgmRNA copies/mL in BAL and (FIG. 8C) $log_{10}$ sgmRNA copies/swab in NS in vaccinated animals. (FIG. 8D) Peak viral loads in BAL and NS following challenge. Red lines reflect median viral loads. P-values indicate two-sided Mann-Whitney tests.

(FIG. 9C) The heat map (top panel) shows the Spearman and Pearson correlations between antibody features and log peak sgmRNA copies/mL in BAL (*q<0.05, q<0.01, *q<0.001, with q-values obtained by Benjamini-Hochberg correction for multiple testing). The bar graph (bottom left panel) shows the rank of the Pearson correlation of the most predictive combination or individual antibody features defined by recursive feature elimination for partial least square regression (PLSR) and random forest (RF) regression. The correlation heatmap (bottom right panel) represents pairwise Pearson correlations between features across all animals.

(FIG. 23A) $\text{Log}_{10}$ viral RNA copies/mL (limit 50 copies/mL) were assessed in bronchoalveolar lavage (BAL) at multiple timepoints following challenge. (FIG. 23B) $\text{Log}_{10}$ viral RNA copies/swab and (FIG. 23C) $\log_{10}$ sgmRNA copies/swab (limit 50 copies/swab) were assessed in nasal swabs (NS) at multiple timepoints following challenge. Red horizontal bars reflect median viral loads.

(FIGS. 25A-25F) H&E sections of fixed lung tissue from 2019-nCoV infected rhesus macaques 2 days following challenge showing (FIG. 25A) interstitial edema and regional lung consolidation, (FIG. 25B) intra-alveolar edema and infiltrates of neutrophils, (FIGS. 25C-25D) bronchiolar epithelial sloughing and necrosis, (FIG. 25E) bronchiolar epithelial syncytial cell formation, and (FIG. 25F) hyaline membranes within alveolar septa. (FIGS. 25G-25H) IHC for SARS nucleocapsid showing virus infected cells within interstitial spaces including (FIG. 25G) a viral syncytial cell within the lumen and (FIG. 25H) virus infected alveolar lining cells. (FIG. 25I) Inflammatory infiltrate showing multiple cells containing 2019-nCoV RNA by RNASCOPE® in situ hybridization. (FIGS. 25J-25L) bronchial respiratory epithelium showing (FIG. 25J) inflammation within the submucosa and transmigration of inflammatory cells into the ciliated columnar respiratory epithelium of a bronchus, (FIG. 25K) 2019-nCoV RNA, and (FIG. 25L) SARS nucleocapsid. Scale bars (FIG. 25A)=200 microns; (25C, 25I, 25K-25L)=100 micron; (FIG. 25G)=50 micron; (FIGS. 25B, 25D-25F, 25J)=20 microns, and (FIG. 25H)=10 microns. H&E=hematoxylin and eosin; IHC=immunohistochemistry; RNAscope=2019-nCoV RNA staining.

(FIG. 26A) Whole slide image of a lung with DAPI staining for cell nuclei, regions of nuclear consolidation (arrows), and foci of viral replication (box). (FIG. 26B) Higher magnification images of inset box showing (FIG. 26C) SARS nucleocapsid positive cells (green) and DAPI for cell nuclei (blue). (FIG. 26D) Brightfield IHC for SARS nucleocapsid from corresponding lung region depicted in (FIG. 26B and FIG. 26C). (FIGS. 26E-26K) SARS-N co-staining with CD206 (FIG. 26E and FIG. 26K), pan-cytokeratin (pan-CK) (FIG. 26G and FIG. 26H), CD68 (FIG. 26I), and Iba-1 (FIG. 26J) showing virally infected epithelial cells and macrophages near an infected epithelial cell. Scale bars (FIGS. 26F-26K)=50 microns.

(FIG. 27A) $Log_{10}$ viral RNA copies/mL (limit 50 copies/mL) were assessed in bronchoalveolar lavage (BAL) at multiple timepoints following re-challenge. One of the naïve animals could not be lavaged. (FIG. 27B) Comparison of viral RNA in BAL following primary challenge and re-challenge. (FIG. 27C) $Log_{10}$ viral RNA copies/mL and (FIG. 27E) $log_{10}$ sgmRNA copies/swab (limit 50 copies/mL) were assessed in nasal swabs (NS) at multiple timepoints following re-challenge. Comparison of (FIG. 27D) viral RNA and (FIG. 27F) sgmRNA in NS following primary challenge and re-challenge. Red horizontal bars reflect median viral loads. P-values reflect two-sided Mann-Whitney tests.

FIG. 29 is a series of graphs showing plasma viral loads in 2019-nCoV challenged rhesus macaques. Groups 1-3 are described in FIG. 23. $Log_{10}$ viral RNA copies/mL (limit 50 copies/mL) were assessed in plasma at multiple timepoints following challenge. Red horizontal bars reflect median viral loads.

(FIG. 33A and FIG. 33F) Detection of 2019-nCoV RNA, (FIG. 33B and FIG. 33G) IHC for myeloperoxidase (MPO), (FIG. 33C and FIG. 33H) double staining for CD4 (brown) and macrophages (CD68 and CD163, red and (vii) wildtype leader sequence with full-length S with mutation of the furin cleavage site and proline stabilizing mutations (S.PP (SS-Spike-dF-PP) (SEQ ID NO: 51)). Red triangle depicts tPA leader sequence, black triangle depicts wildtype leader sequence, red X depicts furin cleavage site mutation, red vertical lines depict proline mutations, open square depicts foldon trimerization domain.

(FIG. 39D) S- and RBD-specific antibody-dependent neutrophil phagocytosis (ADNP), antibody-dependent monocyte cellular phagocytosis (ADCP), antibody-dependent complement deposition (ADCD), and antibody-dependent NK cell activation (ADNKA) at week 4 are shown as radar plots. The size and color intensity of the wedges indicate the median of the feature for the corresponding group (blue depicts antibody functions, red depicts antibody isotype/subclass/FcγR binding). The principal component analysis (PCA) plot shows the multivariate antibody profiles across groups. Each dot represents an animal, the color of the dot denotes the group, and the ellipses shows the distribution of the groups as 70% confidence levels assuming a multivariate normal distribution.

FIGS. 41A-41D are graphs showing viral loads in rhesus macaques following SARS-CoV-2 challenge. Rhesus macaques were challenged by the intranasal and intratracheal routes with $1.2 \times 10^8$ VP ($1.1 \times 10^4$ PFU) SARS-CoV-2. (FIGS. 41A-41B) $Log_{10}$ sgmRNA copies/mL (limit of quantification 50 copies/mL) were assessed in bronchoalveolar lavage (BAL) in sham controls and in vaccinated animals following challenge. (FIGS. 41C-41D) $Log_{10}$ sgmRNA copies/swab (limit of quantification 50 copies/swab) were assessed in nasal swabs (NS) in sham controls and in vaccinated animals following challenge. One animal in the S.dTM.PP (SS-S.Ecto-dF-PP-foldon) group did not have peak BAL samples obtained following challenge. Red lines reflect median values.

(FIG. 43D) The heat map shows the differences in the means of z-scored features between completely protected (N=17) and partially protected and non-protected (N=22) animals. The two groups were compared by two-sided Mann-Whitney tests, and stars indicate the Benjamini-Hochberg corrected q-values (*q<0.05). The dot plots show differences in the features that best discriminated completely protected and partially protected animals, including NAb titers, S-specific antibody-dependent NK cell activation (ADNKA), and antibody-dependent monocyte cellular phagocytosis (ADCP). P-values indicate two-sided Mann-Whitney tests. The bar plot shows the cross-validated area under the receiver operator characteristics curves using the features indicated on the x-axis in a logistic regression model. The top three 1-feature and 2-feature models are shown. Error bars indicate the mean and standard deviation for 100 repetitions of 10-fold cross-validation.

FIGS. 44A-44B are graphs showing immune responses following SARS-CoV-2 challenge. (FIG. 44A) Pseudovirus NAb titers prior to challenge and on day 14 following challenge and (FIG. 44B) IFN-γ+CD8+ and IFN-γ+CD4+ T cell responses by intracellular cytokine staining assays in response to pooled spike (S1, S2), nucleocapsid (NCAP), and non-structural proteins (N6, N7a, N8) peptides on day 14 following challenge in sham controls and in Ad26-S.PP (Ad26 SS-Spike-dF-PP) vaccinated animals. Red bars reflect median responses. Dotted lines reflect assay limit of quantitation.

Figure 51:
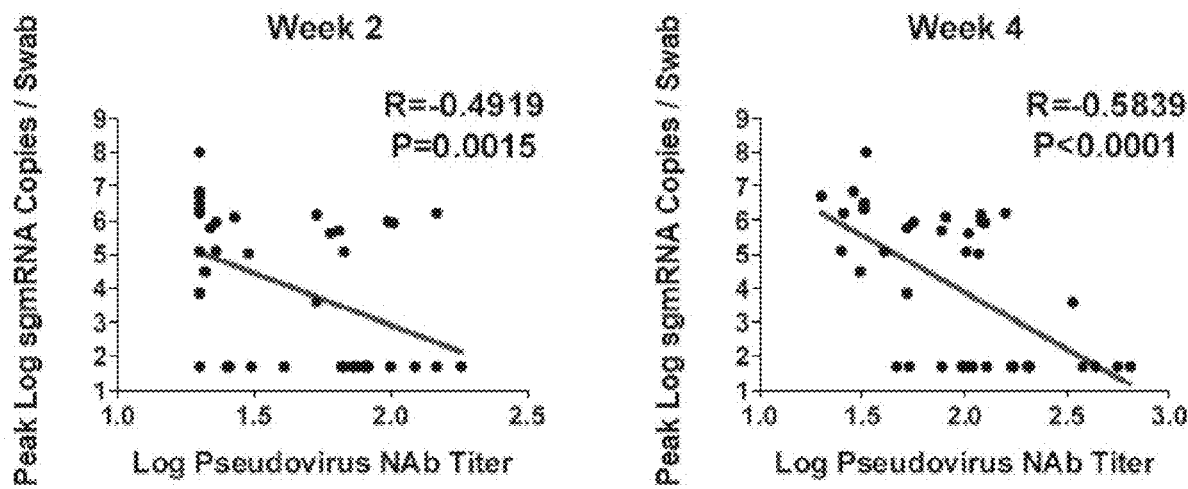

FIG. 51 is a pair of graphs showing pseudovirus NAb correlates of protection. Correlations of pseudovirus NAb titers at week 2 and week 4 with log peak sgmRNA copies/swab in NS following challenge. Red lines reflect the best linear fit relationship between these variables. P and R values reflect two-sided Spearman rank-correlation tests.

Figure 52:
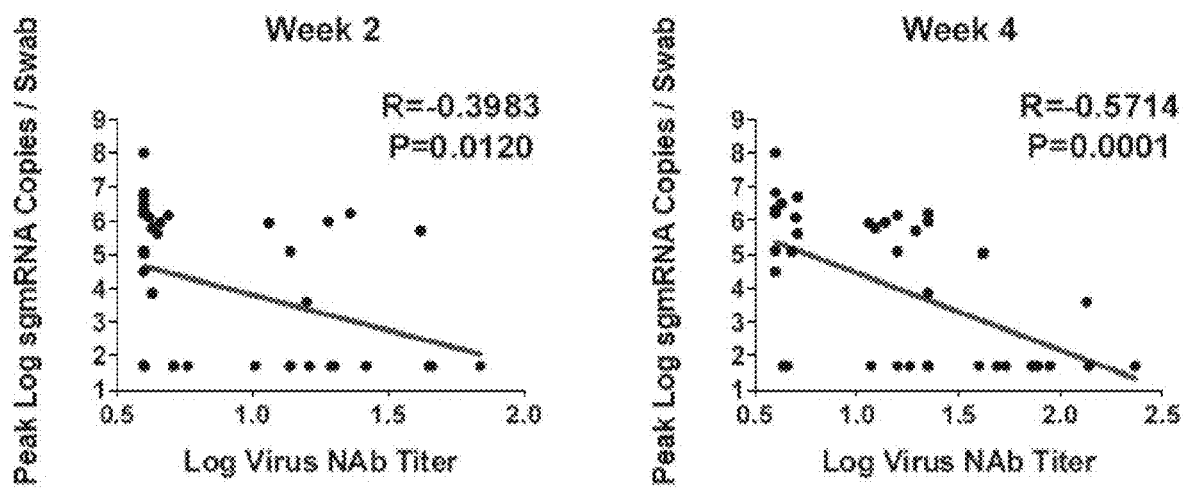

FIG. 52 is a pair of graphs showing live virus NAb correlates of protection. Correlations of live virus NAb titers at week 2 and week 4 with log peak sgmRNA copies/swab in NS following challenge. Red lines reflect the best linear fit relationship between these variables. P and R values reflect two-sided Spearman rank-correlation tests.

Figure 53:
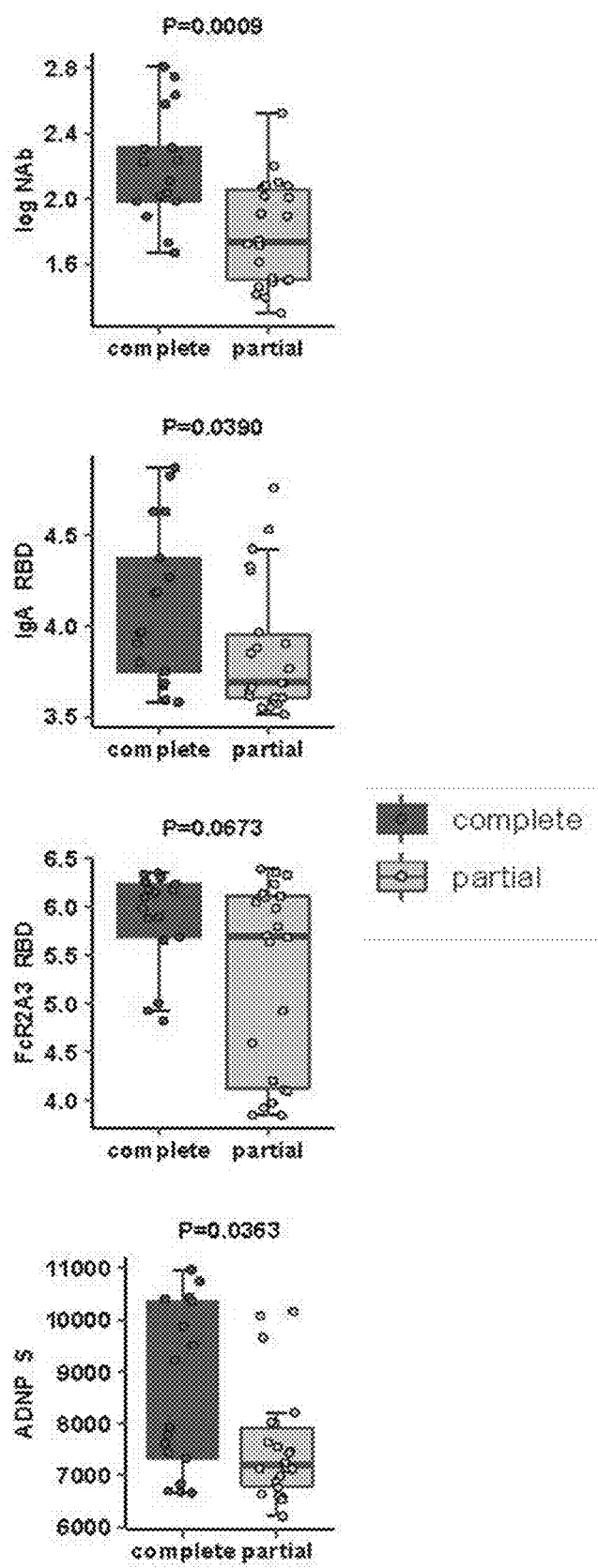

FIG. 53 is a series of graphs showing antibody correlates of protection. The dot plots show differences in the features between completely protected and partially protected animals. P-values indicate two-sided Mann-Whitney tests.

Figure 54:
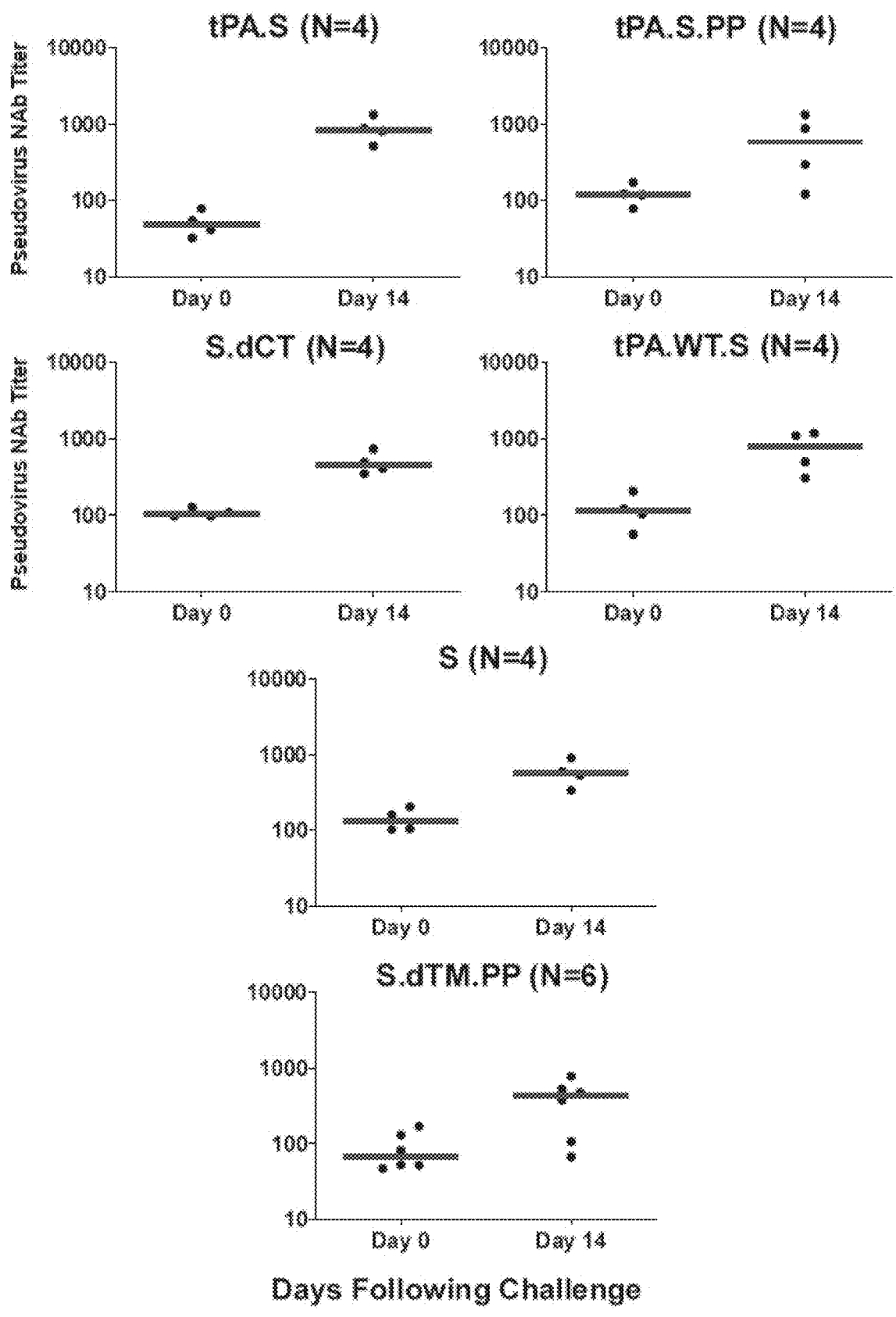

FIG. 54 is a series of graphs showing NAb titers following SARS-CoV-2 challenge. Pseudovirus NAb titers prior to challenge and on day 14 following challenge in vaccinated animals. Red bars reflect median responses. Dotted lines reflect assay limit of quantitation.

Figure 55A:
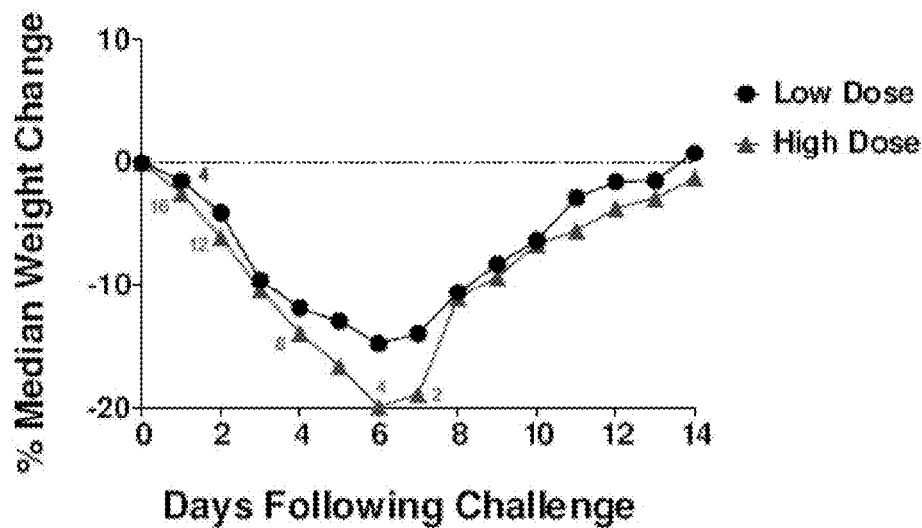
Figure 55B:
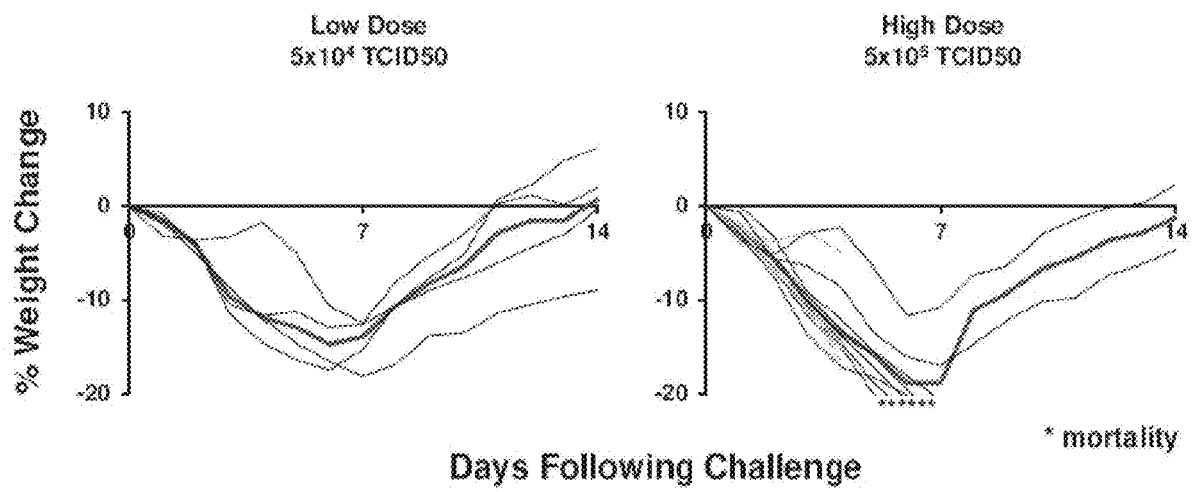
Figure 55C:
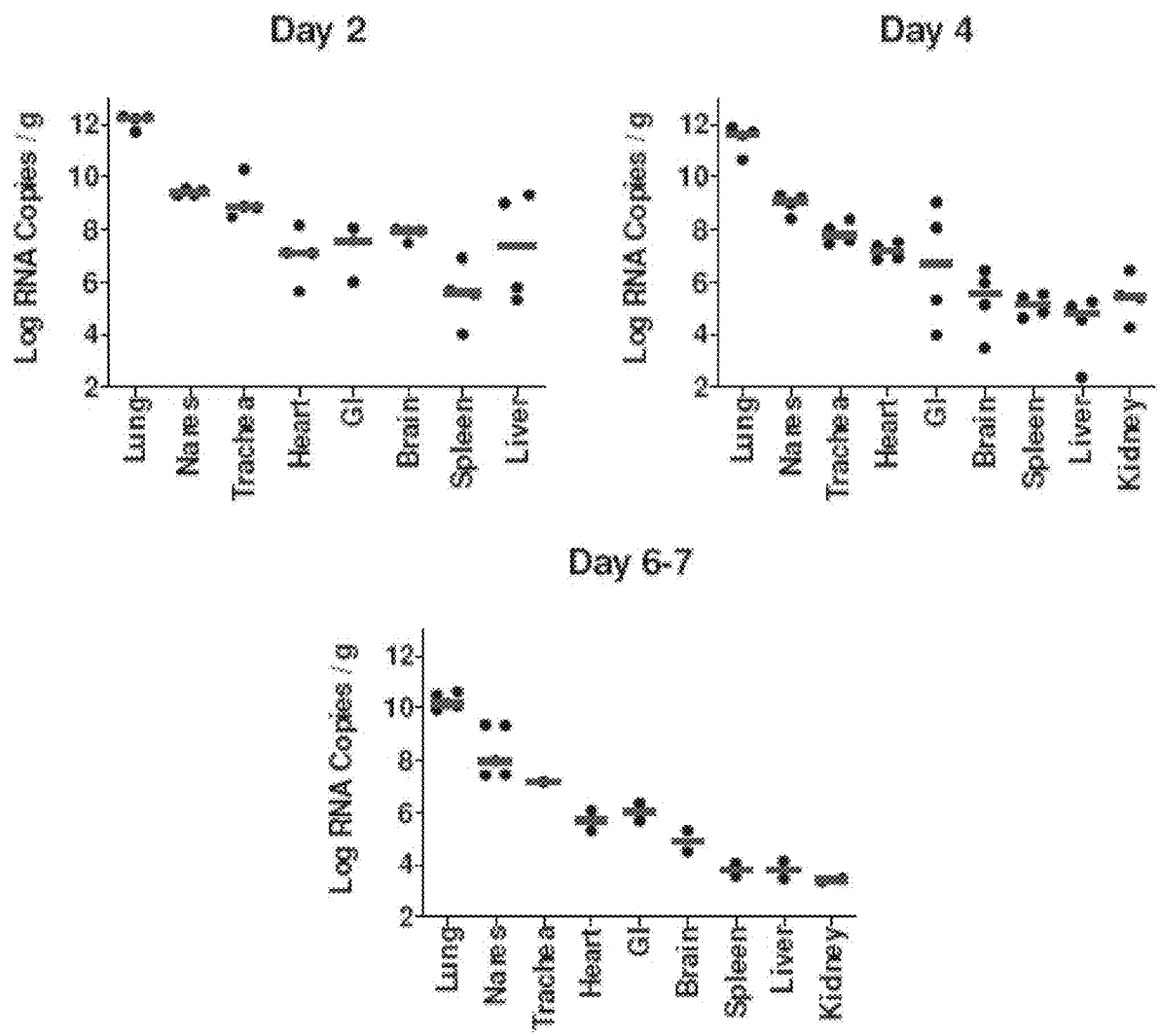

FIGS. 55A-55C are graphs showing clinical disease following SARS-CoV-2 infection in hamsters. Syrian golden hamsters (10-12 weeks old; male and female; N=20) were infected with $5 \times 10^4$ TCID$_{50}$ (low dose; N=4) or $5 \times 10^5$ TCID$_{50}$ (high dose; N=16) of SARS-CoV-2 by the intranasal route. (FIG. 55A) Median percent weight change following challenge. The numbers reflect the number of animals at each timepoint. In the high-dose group, 4 animals were necropsied on day 2, 4 animals were necropsied on day 4, 4 animals met euthanization criteria on day 6, and 2 animals met euthanization criteria on day 7. (FIG. 55B) Percent weight change following challenge in individual animals. Median weight loss is depicted in red. Asterisks indicate mortality. Grey lines indicate animals with scheduled necropsies on day 2 and day 4. (FIG. 55C) Tissue viral loads as measured by log$_{10}$ RNA copies per gram tissue (limit of quantification 100 copies/g) in the scheduled necropsies at day 2 and day 4 and in 2-5 of 6 animals that met euthanization criteria on days 6-7. Extended tissues were not harvested on day 6.

FIGS. 56A-56L are a series of graphs showing pathologic features of high-dose SARS-CoV-2 infection in hamsters. (FIG. 56A) Necrosis and inflammation (arrow) in nasal turbinate, H&E (d2). (FIG. 56B) Bronchiolar epithelial necrosis with cellular debris and degenerative neutrophils in lumen (arrow) and transmigration of inflammatory cells in vessel wall (arrowhead), H&E (d2). (FIG. 56C) Interstitial pneumonia, hemorrhage, and consolidation of lung parenchyma, H&E (d2). (FIG. 56D) Nasal turbinate epithelium shows strong positivity for SARS-CoV-N by IHC (d2). (FIG. 56E) Bronchiolar epithelium and luminal cellular debris show strong positivity for SARS-CoV-N by IHC (d2). (FIG. 56F) Pneumocytes and alveolar septa show multifocal strong positivity for SARS-CoV-N by IHC (d2). (FIG. 56G) Diffuse vRNA staining by RNASCOPE® within pulmonary interstitium (arrow, interstitial pneumonia) and within bronchiolar epithelium (arrowhead; d2). (FIG. 56H) Diffuse vRNA staining by RNASCOPE® within pulmonary interstitium (d4). (FIG. 56I) Iba-1 IHC (macrophages) within pulmonary interstitium (d7). (FIG. 56J) CD3+T lymphocytes within pulmonary interstitium, CD3 IHC (d4). (FIG. 56K) MPO (neutrophil myeloperoxidase) IHC indicating presence of interstitial neutrophils (d7). (FIG. 56L) Interferon-inducible gene, MX1, IHC shows strong and diffuse positivity throughout the lung (d4). H&E, hematoxylin and eosin; IHC, immunohistochemistry; Iba1, ionized calcium binding adaptor protein 1. Representative sections are shown. Scale bars=20 μm (FIGS. 56B, 56D); 50 μm (FIGS. 56A, 56E, 56F); 100 μm (FIGS. 56C, 56G-56L).

FIGS. 57A-57F are a series of graphs showing longitudinal quantitative image analysis of viral replication and associated inflammation in lungs. (FIG. 57A) Percent lung area positive for anti-sense SARS-CoV-2 viral RNA (vRNA) by RNASCOPE® ISH. (FIG. 57B) Percentage of total cells positive for SARS-CoV-N protein (nuclear or cytoplasmic) by IHC. (FIG. 57C) Iba-1 positive cells per unit area by IHC. (FIG. 57D) CD3 positive cells per unit area. (FIG. 57E) MPO positive cells per unit area. (FIG. 57F) Percentage of MX1 positive lung tissue as a proportion of total lung area. ISH, in situ hybridization; IHC, immunohistochemistry; SARS-N, SARS-CoV nucleocapsid; MPO, myeloperoxidase; MX1, myxovirus protein 1 (a type 1 interferon inducible gene). Each dot represents one animal.

Figures 58A, 58O:
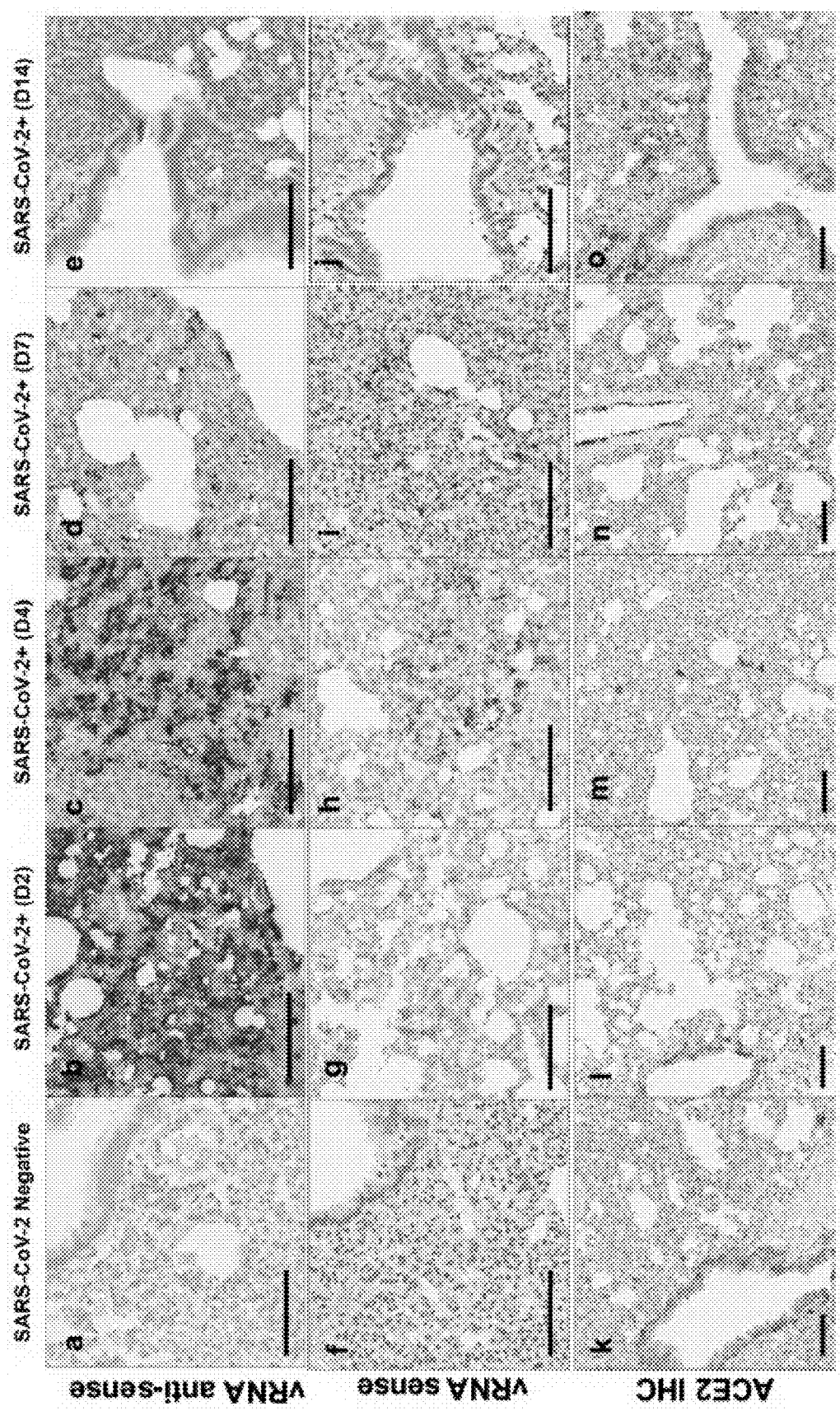

FIGS. 58A-58O are a series of graphs showing lung viral dynamics and ACE2 receptor expression patterns. Hamsters were necropsied before (SARS-CoV-2 Negative) or after high-dose SARS-CoV-2 challenge on day 2 (D2), day 4 (D4), day 7 (D7), and day 14 (D14) following challenge. Serial sections of lung tissue were stained for vRNA anti-sense RNASCOPE® (FIGS. 58A-58E), for vRNA sense RNASCOPE® (FIGS. 58F-58J), and ACE2 IHC (FIGS. 58K-58O). Anti-sense RNASCOPE® used a sense probe; sense RNASCOPE® used an anti-sense probe. IHC, immunohistochemistry. Representative sections are shown. Scale bars=100 μm.

FIGS. 59A-59L are a series of graphs showing extrapulmonary pathology. (FIG. 59A) Anti-sense SARS-CoV-2 viral RNA (vRNA) in brainstem on day 2 following challenge. (FIG. 59B) Higher magnification showing cytoplasmic vRNA staining in neurons in the absence of inflammation and pathology. (FIG. 59C) Anti-sense SARS-CoV-2 vRNA staining in the lamina propria of small intestinal villus on day 2 following challenge. (FIG. 59D) Higher magnification showing cytoplasmic and nuclear vRNA staining in an individual mononuclear cell in the absence of inflammation and tissue pathology. (FIG. 59E) Anti-sense SARS-CoV-2 vRNA staining within the myocardium and along the epicardial surface of the heart on day 4 following challenge. (FIG. 59F) Higher magnification showing staining of inflammatory mononuclear cell infiltrates consistent with focal myocarditis. (FIG. 59G) Pulmonary vessel showing endothelialitis day 4 (d4) following challenge. (FIG. 59H) Pulmonary vessel showing CD3+T lymphocyte staining by IHC adhered to endothelium and within vessel wall, d4 following challenge. (FIG. 59I) Pulmonary vessel showing Iba-1+ staining by IHC of macrophages along endothelium and perivascularly, d4. (FIG. 59J) Pulmonary vessel showing minimal vascular staining for SARS-CoV-N by IHC, d4. (FIG. 59K) Heart from (FIGS. 59E, 59F) showing focal lymphocytic myocarditis as confirmed by CD3+T lymphocyte staining (FIG. 59L) of cells by IHC, d4. Scale bars=500 μm (FIGS. 59A, 59C, 59E); 100 μm (FIGS. 59B, 59D, 59F, 59G-59L).

FIGS. 60A-60F are a series of graphs showing SARS-CoV-2 in blood mononuclear cells and bone marrow. (FIG. 60A-60C) SARS-CoV-2 anti-sense vRNA staining within mononuclear cells within lung thrombus on day 2 following challenge. (FIG. 60D) Bone marrow from the nasal turbinate 4 days following challenge showing (FIG. 60E) hematopoetic cells (H&E) that show (FIG. 60F) positive staining for SARS-CoV-N IHC. vRNA, viral RNA; H&E, hematoxylin and eosin; IHC, immunohistochemistry. Scale bars=500 µm (FIG. 60A); 200 µm (FIG. 60D); 100 µm (FIG. 60B, 60C, 60E, 60F).

FIGS. 61A-61F are graphs showing humoral immune responses in vaccinated hamsters. (FIG. 61A) SARS-CoV-2 spike (S) immunogens with (i) deletion of the transmembrane region and cytoplasmic tail reflecting the soluble ectodomain with a foldon trimerization domain (S.dTM.PP) or (ii) full-length S (S.PP), both with mutation of the furin cleavage site and two proline stabilizing mutations. Red X depicts furin cleavage site mutation, red vertical lines depict proline mutations, open square depicts foldon trimerization domain. S1 and S2 represent the first and second domain of the S protein, TM depicts the transmembrane region, and CT depicts the cytoplasmic domain. Hamsters were vaccinated with $10^{10}$ vp or $10^9$ vp of Ad26-S.dTM.PP or Ad26-S.PP or sham controls (N=10/group). Humoral immune responses were assessed at weeks 0, 2, and 4 by (FIG. 61B) RBD-specific binding antibody ELISA and (FIG. 61C) pseudovirus neutralization assays. Red bars reflect median responses. Dotted lines reflect assay limit of quantitation. (FIG. 61D) S- and RBD-specific IgG subclass, FcγR, and ADCD responses at week 4 are shown as radar plots. The size and color intensity of the wedges indicate the median of the feature for the corresponding group (antibody subclass, red; FcγR binding, blue; ADCD, green). (FIG. 61E) Principal component analysis (PCA) plot showing the multivariate antibody profiles across vaccination groups. Each dot represents an animal, the color of the dot denotes the group, and the ellipses show the distribution of the groups as 70% confidence levels assuming a multivariate normal distribution. (FIG. 61F) The heat map shows the differences in the means of z-scored features between vaccine groups S.PP and S.dTM.PP. The two groups were compared by two-sided Mann-Whitney tests and stars indicate the Benjamini-Hochberg corrected q-values (*$q<0.05$,  $q<0.01$, * $q<0.001$).

Figure 62A:
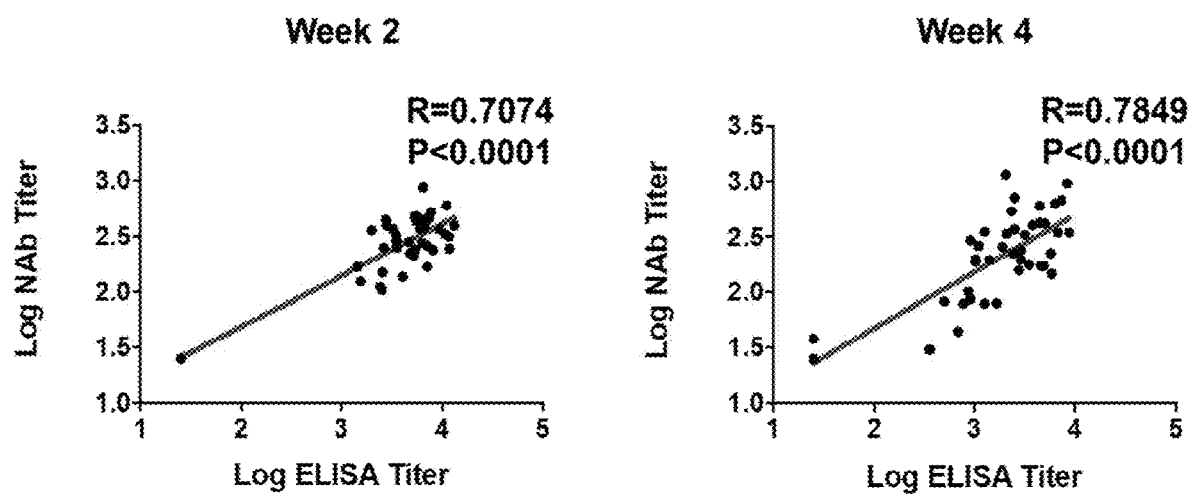
Figure 62B:
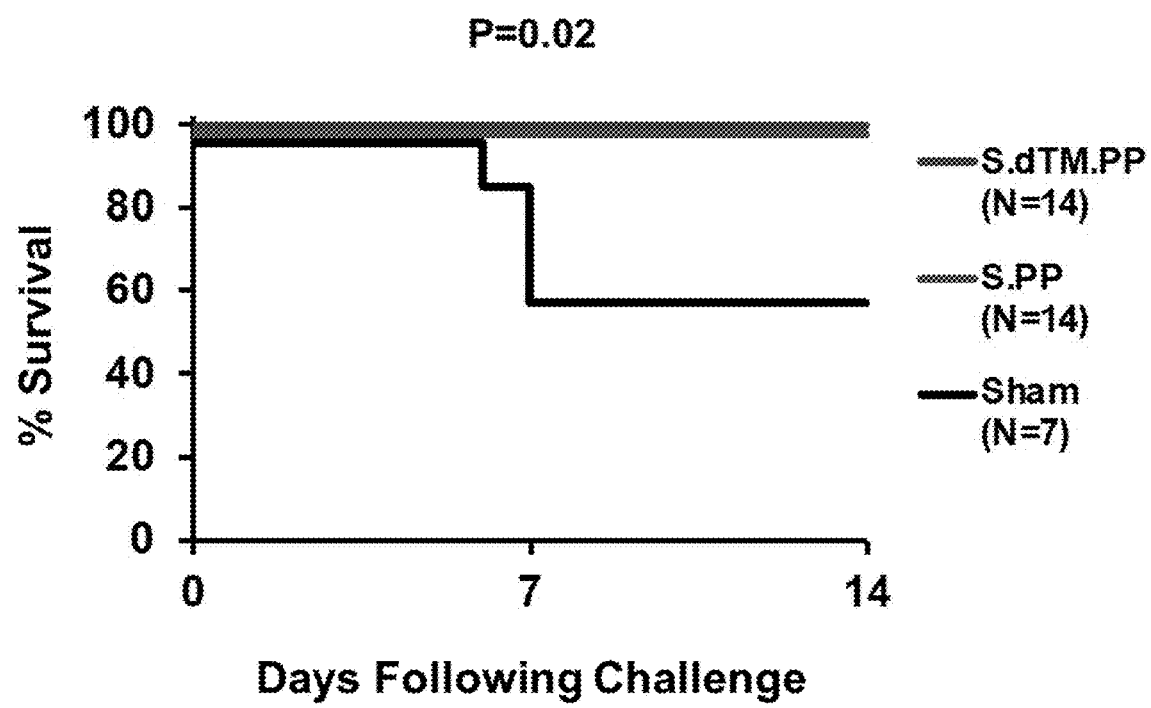
Figure 62C:
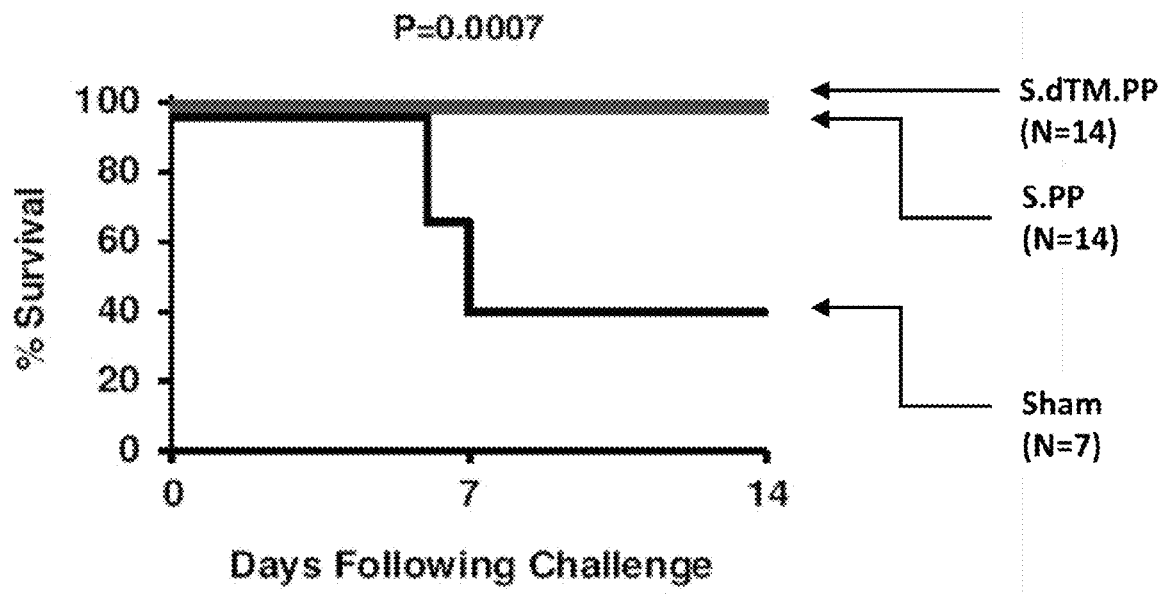

FIGS. 62A-62C are graphs showing the correlation of antibody titers and survival curves. (FIG. 62A) Correlations of binding ELISA titers and pseudovirus NAb titers at week 2 and week 4. Red lines reflect the best linear fit relationship between these variables. P and R values reflect two-sided Spearman rank-correlation tests. (FIG. 62B) Survival curve for the vaccine study. P values indicate two-sided Fisher's exact tests. N denotes number of animals in each group. (FIG. 62C) Combined analysis of the two hamster studies involving all animals that received the $5\times10^5$ TCID$_{50}$ challenge dose and were followed longitudinally. P values indicate two-sided Fisher's exact tests. N denotes number of animals in each group.

FIGS. 63A-63D are graphs showing clinical disease in hamsters following high-dose SARS-CoV-2 challenge. (FIG. 63A) Median percent weight change following challenge. (FIG. 63B) Percent weight change following challenge in individual animals. Median weight loss is depicted in red. Asterisks indicate mortality. Grey lines indicate animals with scheduled necropsies on day 4. (FIG. 63C) Maximal weight loss in the combined Ad26-S.dTM.PP (N=14), Ad26-S.PP (N=14), and sham control (N=7) groups, excluding the animals that were necropsied on day 4. P values indicate two-sided Mann-Whitney tests. (FIG. 63D) Quantification of percent lung area positive for anti-sense vRNA in tissue sections from Ad26-S.dTM.PP and Ad26-S.PP vaccinated hamsters as compared to control hamsters on day 4 following challenge. P values represent two-sided Mann-Whitney tests.

Figure 64A:
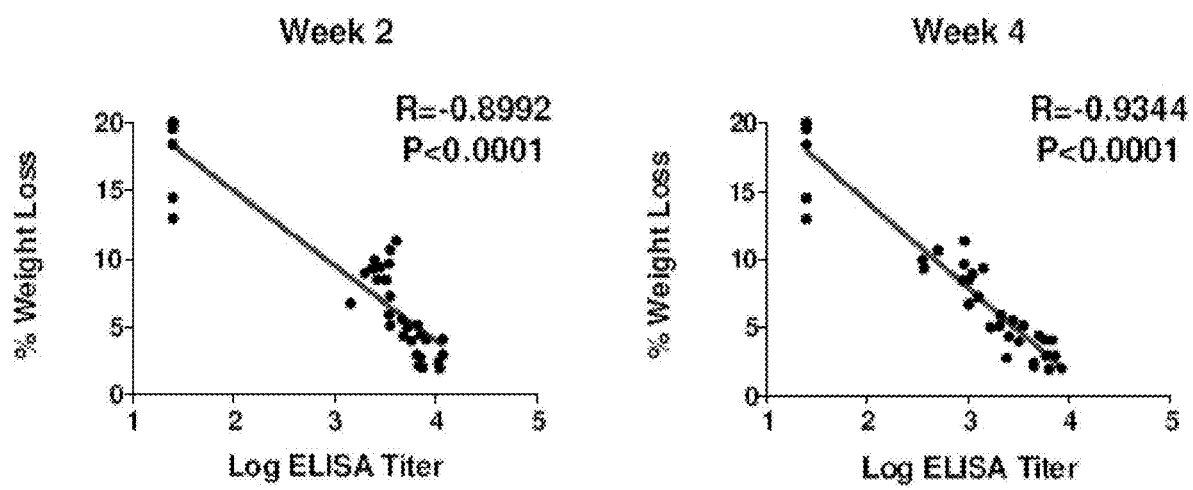
Figure 64B:
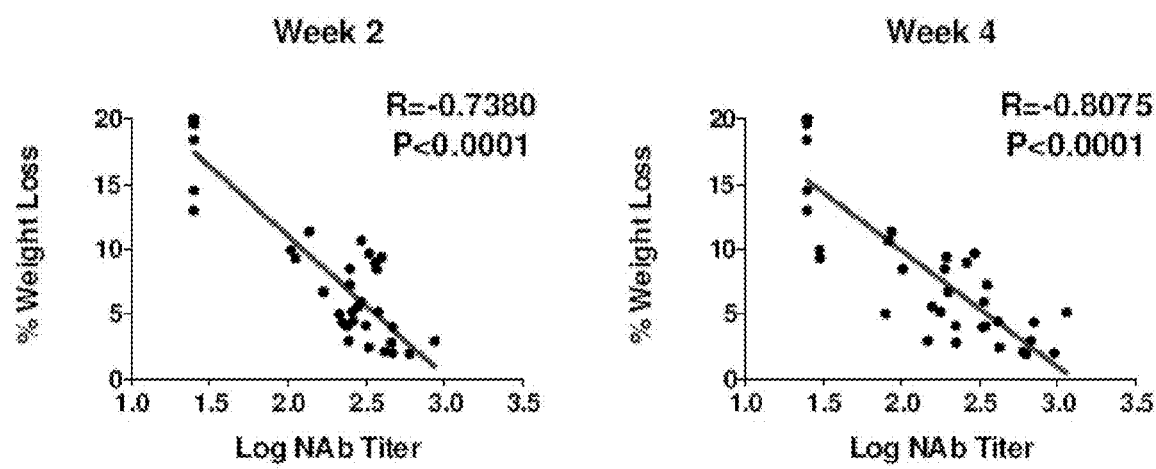

FIGS. 64A-64B are graphs showing antibody correlates of clinical protection. Correlations of (FIG. 64A) binding ELISA titers and (FIG. 64B) pseudovirus NAb titers at week 2 and week 4 with maximum percent weight loss following challenge. Red lines reflect the best linear fit relationship between these variables. P and R values reflect two-sided Spearman rank-correlation tests.

Figure 65A:
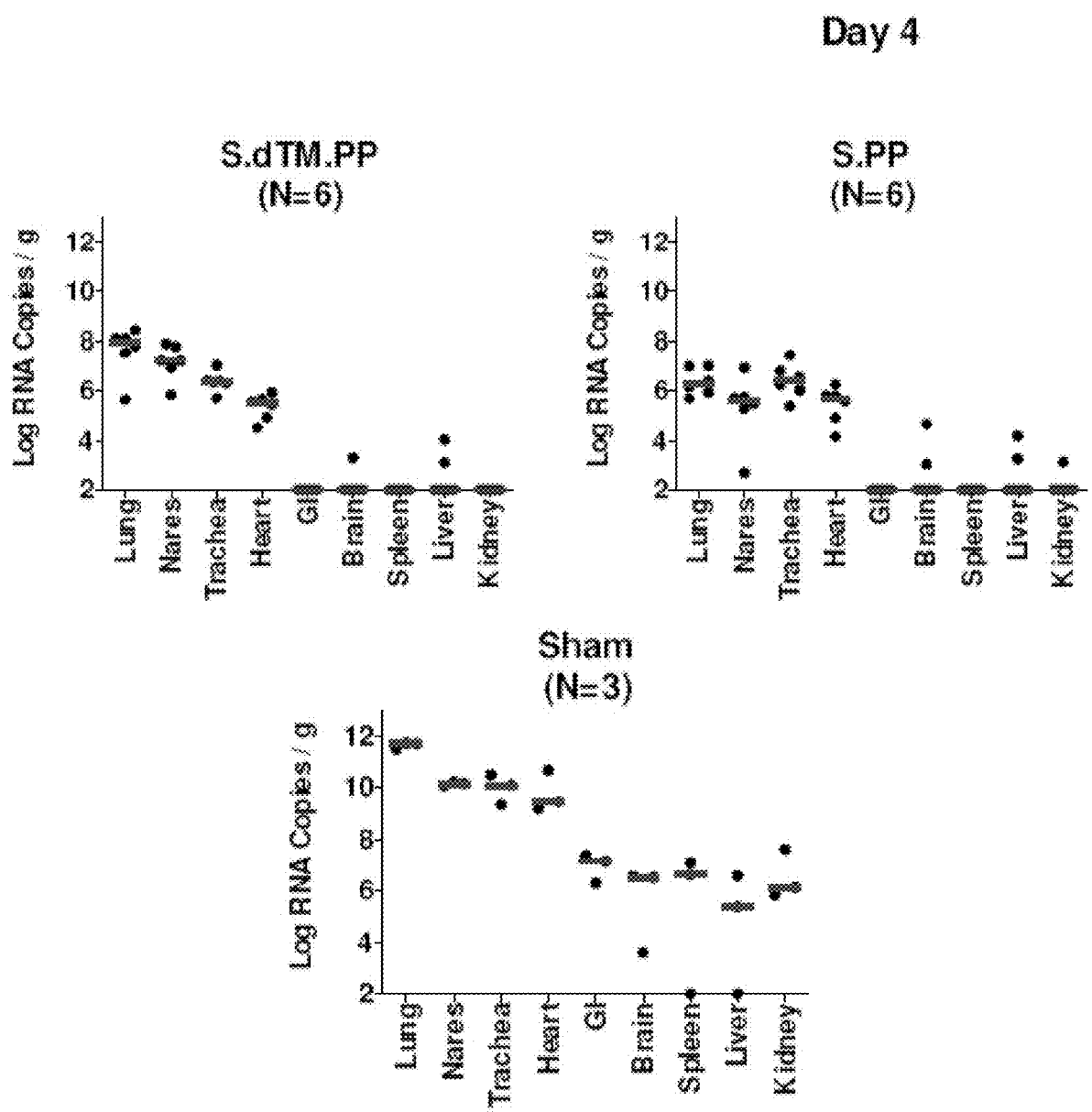
Figure 65B:
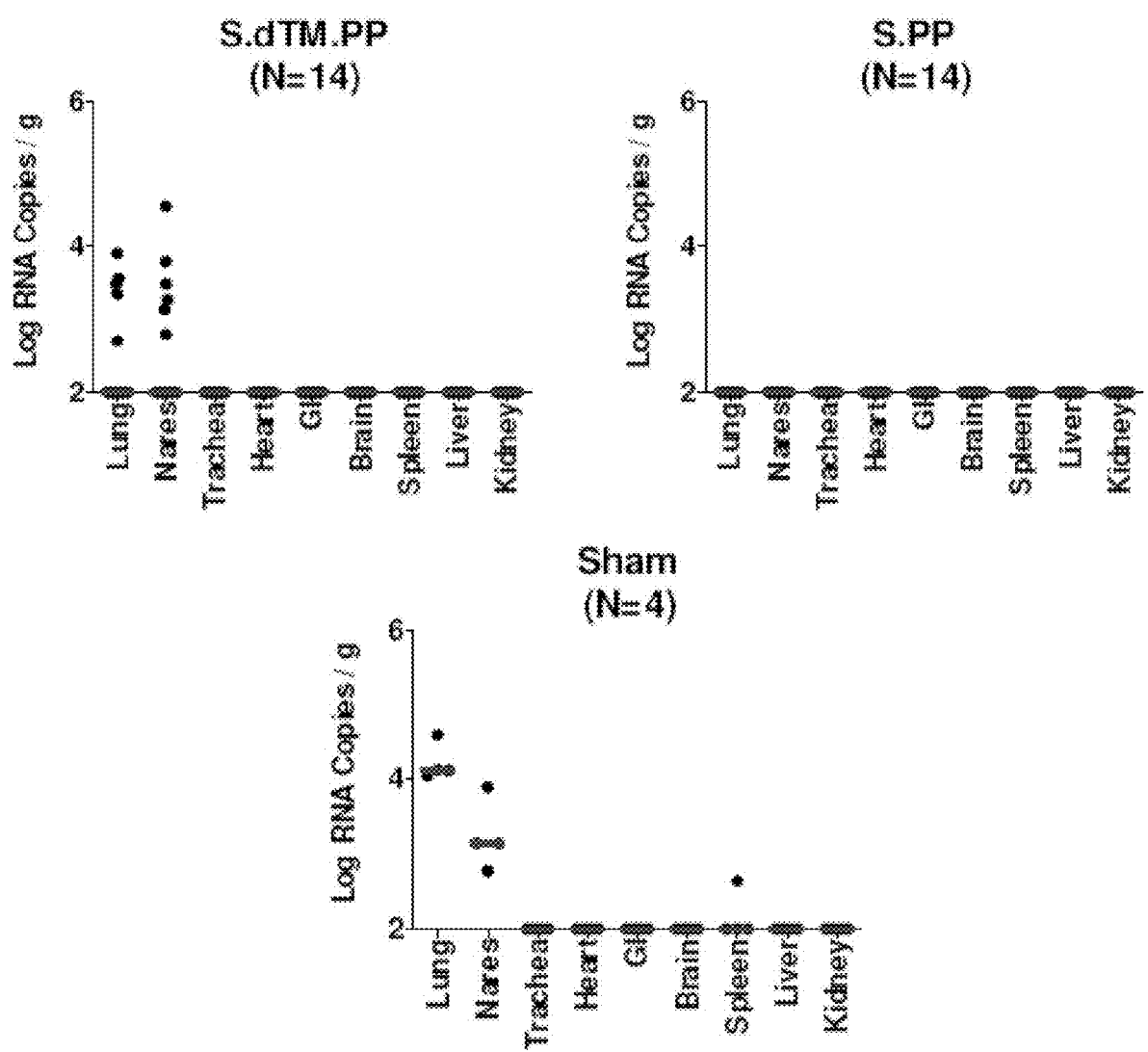

FIGS. 65A-65B are graphs showing tissue viral loads on day 4 and day 14. Tissue viral loads as measured by $\log_{10}$ subgenomic RNA copies per gram tissue (limit of quantification 100 copies/g) on (FIG. 65A) day 4 (N=6 reflects both dose groups for each vaccine) and (FIG. 65B) day 14 (N=14 reflects both dose groups for each vaccine) following challenge. Red lines reflect median values. Each dot represents one animal.

FIGS. 66A-66D are graphs showing antibody correlates of protection. Correlations of (FIGS. 66A, 66C) binding ELISA titers and (FIGS. 66B, 66D) pseudovirus NAb titers at week 2 and week 4 with $\log_{10}$ RNA copies per gram (FIGS. 66A, 66B) lung and (FIGS. 66C, 66D) nasal turbinate tissue in the animals that were necropsied on day 4. Red lines reflect the best linear fit relationship between these variables. P and R values reflect two-sided Spearman rank-correlation tests.

Figure 67A:
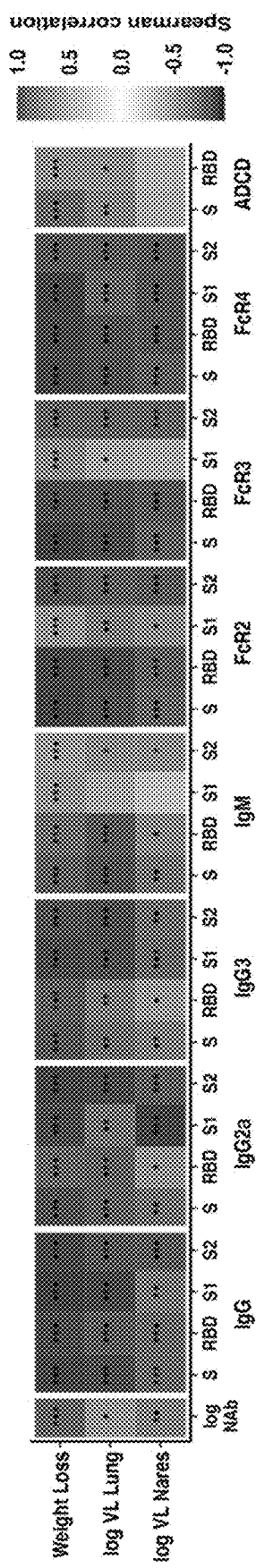
Figure 67B:
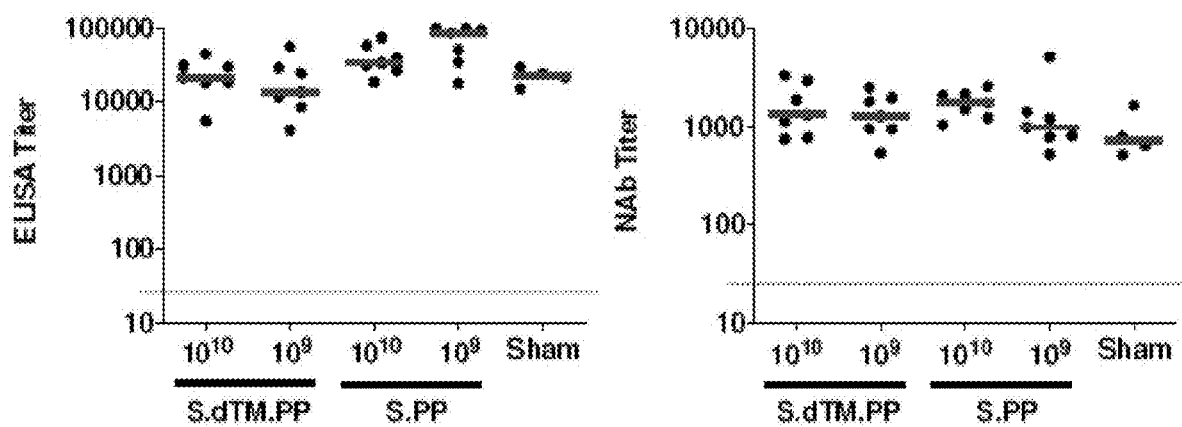

FIGS. 67A-67B are graphs showing antibody correlates of protection and anamnestic responses. (FIG. 67A) The heatmaps show the Spearman rank correlation between antibody features and weight loss (N=35), lung viral loads (N=12), and nasal turbinate viral loads (N=12). Significant correlations are indicated by stars after multiple testing correction using the Benjamini-Hochberg procedure (*$q<0.05$,  $q<0.01$, * $q<0.001$). (FIG. 67B) ELISA and NAb responses in surviving hamsters on day 14 following SARS-CoV-2 challenge.

Figures 68A, 68R:
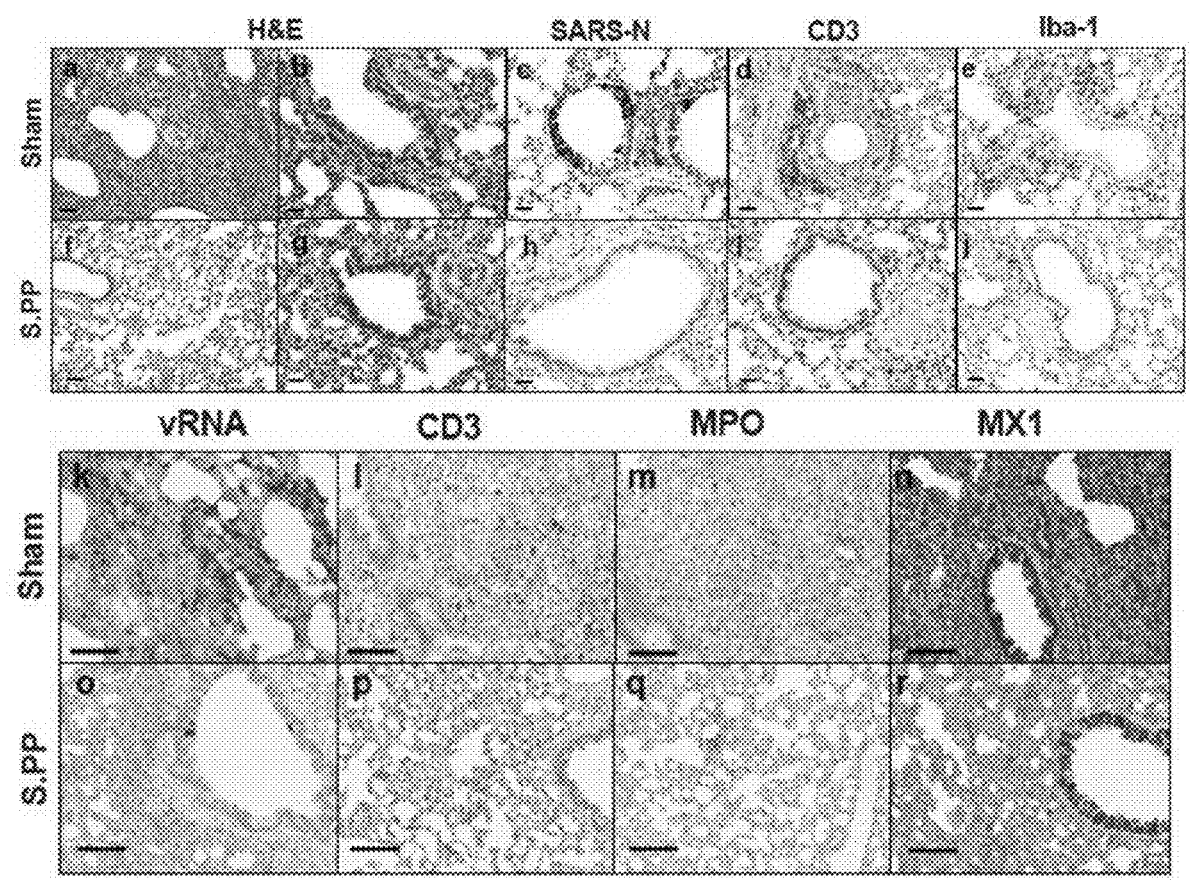
Figure 68S:
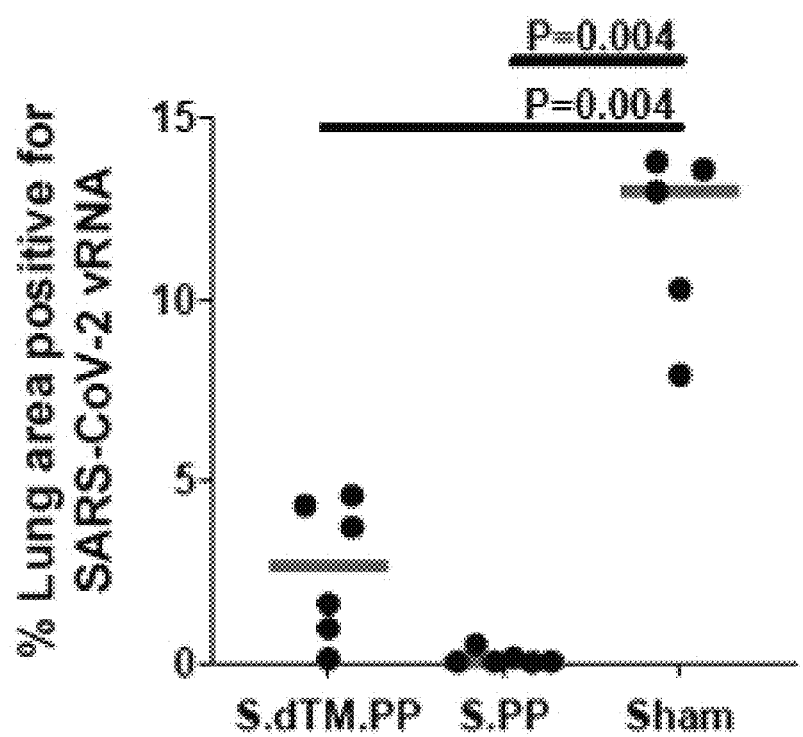

FIGS. 68A-68S is a series of graphs showing Ad26 vaccination protects against SARS-CoV-2 pathology. Histopathological H&E evaluation of (FIGS. 68A-68E, 68K-68N) sham controls and (FIGS. 68F-J, 68O-R) Ad26-S.PP vaccinated hamsters shows in sham controls (FIG. 68A) severe consolidation of lung parenchyma and infiltrates of inflammatory cells, (FIG. 68B) bronchiolar epithelial syncytia and necrosis, (FIG. 68C) SARS-CoV-N positive (IHC) bronchiolar epithelial cells, (FIG. 68D) peribronchiolar CD3+T lymphocyte infiltrates, and (FIG. 68E) peribronchiolar macrophage infiltrates (Iba-1; IHC), and (FIGS. 68F-J) minimal to no corresponding pathology in Ad26-S.PP vaccinated animals. SARS-CoV-2 anti-sense RNASCOPE® ISH in (FIG. 68K), interstitial CD3+T lymphocytes (FIG. 68L) MPO staining by IHC, and MX1 staining by IHC (FIG. 68N) in sham controls compared to similar regions in Ad26-S.PP vaccinated animals (FIGS. 68O-68R) on day 4 following challenge. Quantification of percent lung area positive for anti-sense vRNA (FIG. 68S) in tissue sections from Ad26-S.dTM.PP and Ad26-S.PP vaccinated hamsters as compared to control hamsters 4 days following challenge. Representative sections are shown. P values represent two-sided Mann-Whitney tests. Scale bars=20 µm (FIGS. 68B, 68C, 68G, 68H, 68I); 50 µm (FIGS. 68A, 68D, 68E, 68J); 100 µm (FIGS. 68F, 68K-68R).

Figure 69:
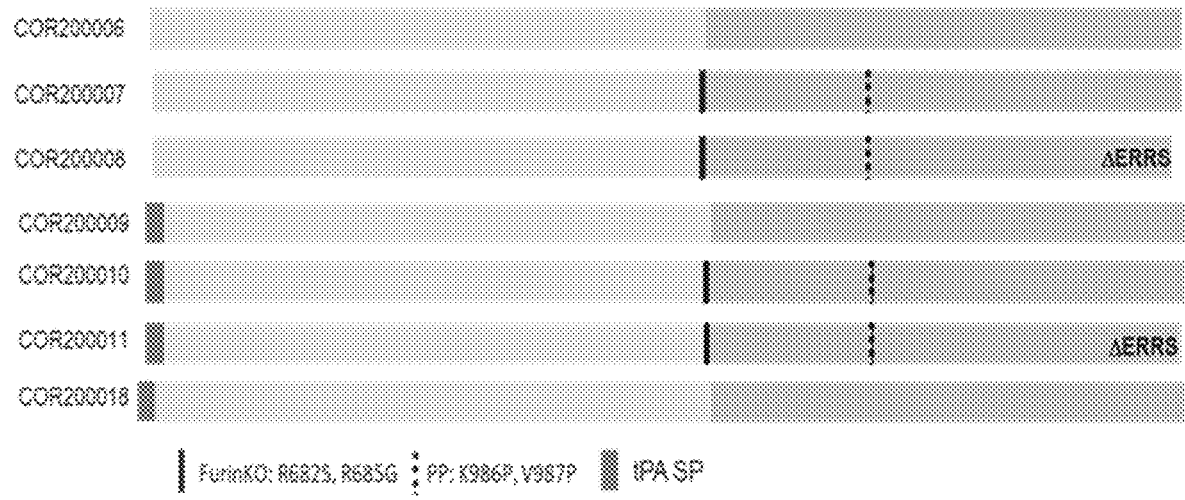

FIG. 69: Schematic representation of several designs of SARS-CoV-2 S constructs (S1 light grey, S2 dark grey). In the bottom designs, the wildtype (wt) signal peptide was changed to the tPA signal peptide. Vertical line between S1 and S2 indicates the mutation in the furin cleavage site.

Dotted line indicates the double proline mutations at position 986 and 987. Delta ERRS indicates deletion of the C-terminal residues that contain the endoplasmic reticulum retention signal.

Figure 70:
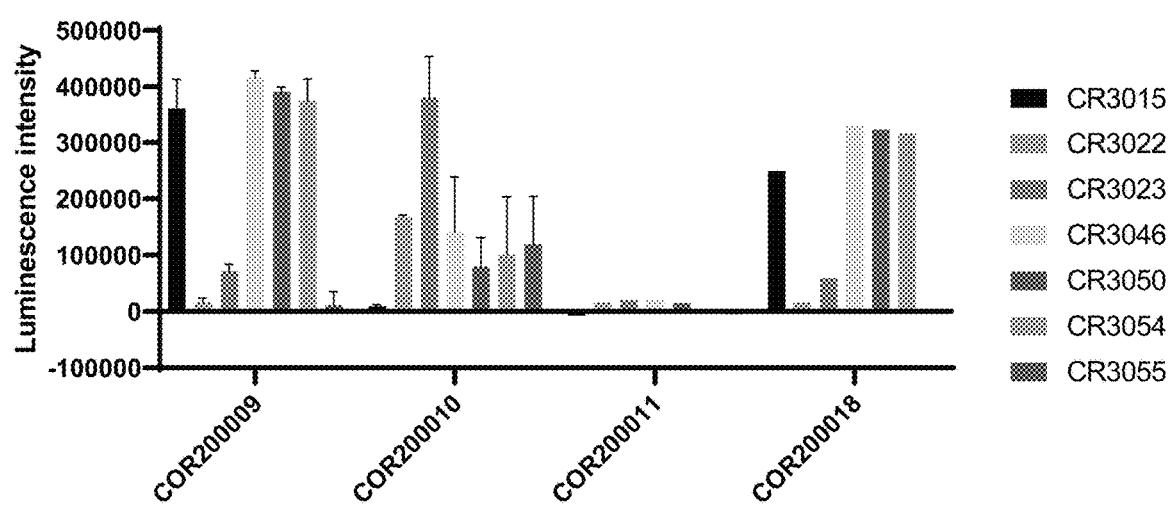

FIG. 70: Detection of expression of SARS-CoV-2 S with several SARS-CoV-1 specific antibodies on the cell surface after transfection with several different S variants based on luminescence intensities using a cell-based ELISA. Data are represented as mean±SEM.

FIG. 71: Detection of expression of SARS-CoV-2 S with several SARS-CoV-1 specific antibodies and an antibody specific for a high-mannose patch on HIV gp120 (2G12), on the cell surface after transfection with several different S variants using flow cytometry. Data are represented as mean±SEM.

FIG. 72: Serum SARS-CoV-2 Spike-specific antibody titers on day 19 by ELISA. ULOQ, upper limit of detection; LLOD, lower limit of detection. Statistical analysis: One-way ANOVA with Bonferroni multiple comparison correction; n.s., not significant ($p>0.05$).

FIG. 73: Effect of different signal peptides on protein expression. Detection of expression of SARS-CoV-2 S constructs with different signal peptides with a ACE2-antibody construct and SARS-CoV-1 specific antibody (CR3022) on the cell surface based on luminescence intensities using cell-based ELISA. Data are represented as mean±SEM.

FIG. 74: Cloning the SARS-CoV-2 coding sequence in linearized target vector. Two DNA fragments coding parts of SARS-CoV-2 spike protein were assembled into their target vector.

FIG. 75: Introduction of expression cassette coding the SARS-CoV-2 sequence into the E1 region of the Ad26 vector.

FIGS. 76A-76B: S protein binding antibody titers as measured by ELISA. (FIG. 76A) week 2; (FIG. 76B) week 4. The median response per group is indicated with a horizontal line. The dotted line indicates the LLOD. Across-dose comparisons between Ad26NCOV030 (Ad26COVS1), Ad26NCOV006, and Ad26NCOV028 (data not shown) were performed with a t-test from ANOVA with Bonferroni correction for multiple comparisons. *: $p<0.05$. LLOD=lower limit of detection.

FIGS. 77A-77B: Neutralizing antibody titers as measured by wtVNA determining the cytopathic effect (CPE) of virus isolate Leiden1 (L-001) on Vero E6 cells. (FIG. 77A) week 2; (FIG. 77B) week 4. The median response per group is indicated with a horizontal line. The dotted line indicates the LLOD. Animals with a response at or below the LLOD are shown as open symbols. wtVNA=wild-type virus neutralization assay. Across-dose comparisons between Ad26NCOV030 (Ad26COVS1), Ad26NCOV006, and Ad26NCOV028 (data not shown) were performed with a z-test for Tobit ANOVA with Bonferroni correction for multiple comparisons. **: $p<0.01$.

FIG. 78: SARS-CoV-2 S Protein Specific Cellular Response in Mice; The sum of SFU from stimulation with peptide pools 1 and 2 is shown. IFN-γ production by splenocytes was measured by ELISpot after 18 hours of peptide stimulation. The dotted line indicates the LLOD of 200 IFN-γ SFU/$10^6$ unstimulated splenocytes incubated with medium and DMSO. Animals with a response at or below the LLOD are shown as open symbols.

FIGS. 79A-79C: Cytokine concentration in cell supernatant was determined by a Multiplex ELISA based analysis, and ratios were calculated. (FIG. 79A) Ratio IFNγ/IL-4; (FIG. 79B) Ratio IFNγ/IL-5; (FIG. 79C) Ratio IFNγ/IL-10. The median ratio per group is indicated with a horizontal line. Statistical difference between Ad26COVS1 (Ad26NCOV030) and adjuvanted S protein calculated by Mann-Whitney U-test with 2-fold Bonferroni correction. ***: $p<0.001$.

FIGS. 80A-80C: S protein binding IgG1 and IgG2a titers were measured by ELISA. (FIG. 80A) IgG1; (FIG. 80B) IgG2a. The median response per group is indicated with a horizontal line. Dotted lines indicate the LLOD and ULOD of the assays. Animals with a response at or below the LLOD or at or above the ULOD are shown as open symbols. (FIG. 80C) The ratio of IgG2a/IgG1 titers was calculated. The median response per group is indicated with a horizontal line. The dotted line indicates an IgG2a/IgG1 ratio of 1. Animals with a response at or below the LLOD in the IgG2a ELISA are shown as open symbols. Statistical comparison of Ad26COVS1 (Ad26NCOV030) to the adjuvanted S protein analyzed by Mann-Whitney U-test with a 2-fold Bonferroni correction. **: $p<0.01$.

FIGS. 81A-81B: (FIG. 81A) S protein binding antibody titers as measured by ELISA. (FIG. 81B) Neutralizing antibody titers as measured by wtVNA determining the cytopathic effect (CPE) of virus isolate Leiden1 (L-001) on Vero E6 cells. The median response per group is indicated with a horizontal line. The lower dotted line indicates the LLOD of 1.699 $\log_{10}$ for ELISA and 5.7 for wtVNA. Animals with a response at or below the LLOD are shown as open symbols. Across-dose comparisons were performed with a t-test from ANOVA (ELISA) and with a Cochran-Mantel-Haenszel test (wtVNA), with Bonferroni adjustment for multiple comparisons.

FIG. 82: IFN-γ production by PBMC measured after 18 hours of peptide stimulation by ELISpot. The sum of SFU from stimulation with peptide pools 1 and 2 is shown. The dotted line indicates the LOB of 4.5 IFN-γ SFU/$10^6$ PBMC, calculated as the 95th percentile of SFU from unstimulated cells incubated with medium and DMSO. Animals with a response at or below the LOB are shown as open symbols. Across-dose comparisons were performed with a t-test from ANOVA, with Bonferroni correction for multiple comparisons.

FIGS. 83A-83B: (FIG. 83A) S protein binding antibody titers as measured by ELISA. Ad26.Empty sample N=18. (FIG. 83B) Neutralizing antibody titers as measured by wtVNA determining the cytopathic effect (CPE) of virus isolate Leiden1 (L-001) on Vero E6 cells. Ad26.Empty group shown as 2 pooled sera groups, from Group 7 (N=6) and Group 8 (N=6). The median response per group is indicated with a horizontal line. The dotted line indicates the LLOD. Animals with a response at or below the LLOD are shown as open symbols. ELISA data comparisons were performed per dose between Ad26COVS1 (Ad26NCOV030) and Ad26.Empty by Mann-Whitney U-test. No corrections for multiple comparisons were made. ***: $p<0.001$.

FIG. 84: Replication competent virus ($TCID_{50}$ per gram lung) measured by plaque assay. The median viral load per group is indicated with a horizontal line. Animals with a response at or below the LLOD are shown as open symbols. Comparisons were performed between the Ad26.Empty group and the Ad26COVS1 (Ad26NCOV030) and Ad26NCOV006 groups by Mann-Whitney U-test. No corrections for multiple comparisons were made. **: $p<0.01$.

FIG. 85: Body weight as measured prior to challenge on Day relative to challenge [C]0 and 4 days post challenge on Day C4. The relative change in body weight is expressed as the body weight % relative to Day C0. The median change in body weight per group is indicated with a horizontal line.

Comparisons were performed between the Ad26.Empty group and the Ad26COVS1 (Ad26NCOV030) and Ad26NCOV006 groups by t-test from ANOVA. No corrections for multiple comparisons were made. *: p<0.001; : p<0.01; *: p<0.05.

FIGS. 86A-86D: (FIG. 86A) S protein binding antibody titers as measured by ELISA. (FIG. 86B) Neutralizing antibody titers as measured by ppVNA. (FIG. 86C) Neutralizing antibody titers as measured by wtVNA using the Seattle Wash. isolate, designed to express luciferase and GFP, incubated on Vero E6 cells. The titers were measured via Nano-Glo Luciferase Assay System. (FIG. 86D) IFN-γ production of SARS-CoV-2 peptide stimulated PBMC as measured by ELISpot. The sum of SFU from stimulation with peptide pools 1 and 2 is shown. The dotted line indicates the LOB of 50 IFN-γ SFU/$10^6$ PBMC. Animals with a response at or below the LOB are shown as open symbols. The median response per group is indicated with a horizontal line. The dotted line indicates the LLOD of 25 for ELISA, 20 for ppVNA, and 4 for wtVNA. Animals with a response at or below the LLOD are shown as open symbols. ppVNA=pseudotyped virus neutralization assay; SFU=spot forming units; vp=virus particles; wtVNA=wild-type virus neutralization assay.

Figure 87:
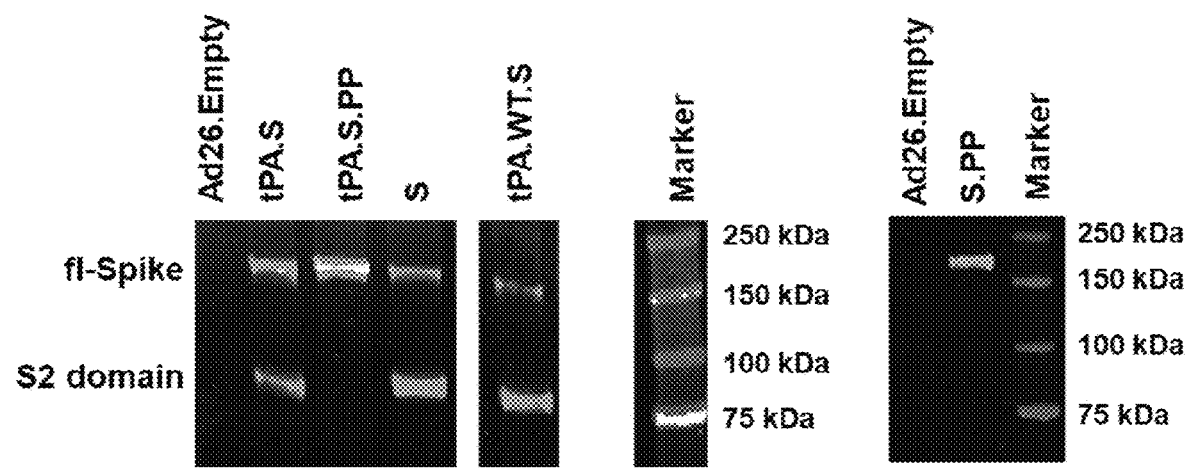

FIG. 87: Western blot analyses for expression from Ad26 vectors encoding tPA.S (lane 1), tPA.S.PP (lane 2), S (lane 3), S.dCT (lane 4), tPA.WT.S (lane 5), S.dTM.PP (lane 6), and S.PP (lane 7) in cell lysates using an anti-SARS polyclonal antibody.

Figure 88A:
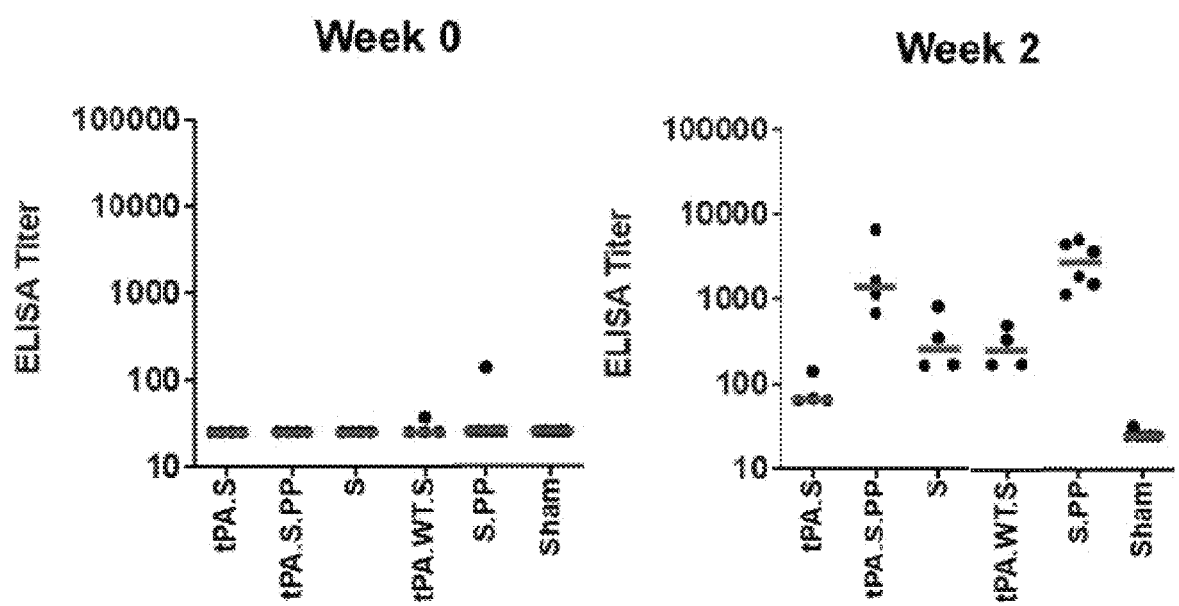

FIGS. 88A-88B: Humoral immune responses in vaccinated rhesus macaques. Humoral immune responses were assessed at weeks 0, 2, and 4 by (FIG. 88A) RBD-specific binding antibody ELISA, and (FIG. 88B) pseudovirus neutralization assays. Red (solid) bars reflect median responses.

Figure 89B:
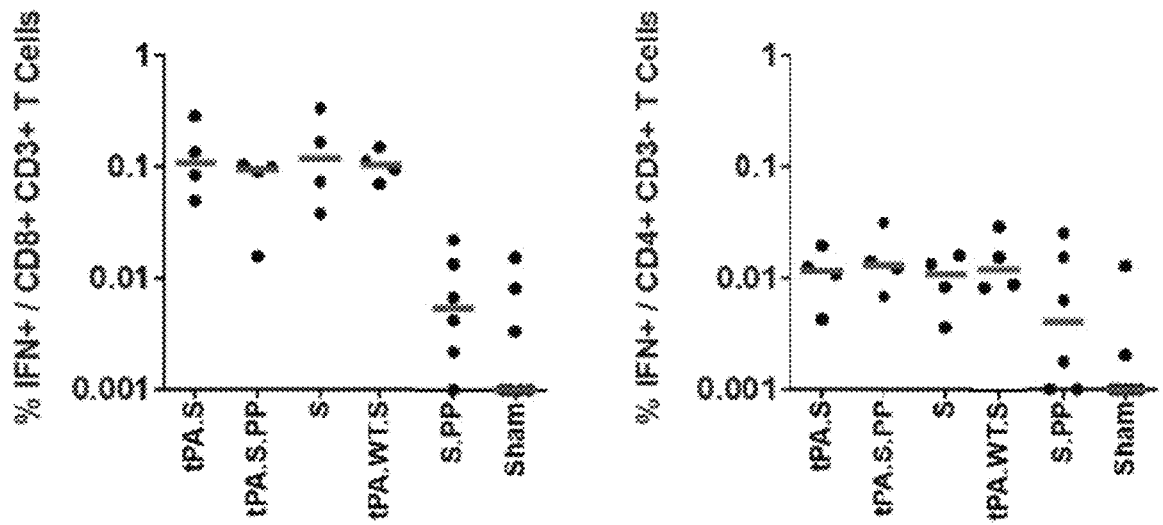

FIGS. 89A-89B: Cellular immune responses in vaccinated rhesus macaques. Cellular immune responses were assessed at week 4 following immunization by (FIG. 89A) IFN-γ ELISPOT assays and (FIG. 89B) IFN-γ+CD4+ and IFN-γ+CD8+ T cell intracellular cytokine staining assays in response to pooled S peptides. Red (solid) bars reflect median responses.

FIGS. 90A-90D: Viral loads in rhesus macaques following SARS-CoV-2 challenge. Rhesus macaques were challenged by the intranasal and intratracheal route with $1.2 \times 10^8$ VP ($1.1 \times 10^4$ PFU) SARS-CoV-2. (FIG. 90A, FIG. 90B) $Log_{10}$ sgmRNA copies/ml (limit 50 copies/nil) were assessed in bronchoalveolar lavage (BAL) in sham controls and in vaccinated animals following challenge. (FIG. 90C, FIG. 90D) $Log_{10}$ sgmRNA copies/swab (limit 50 copies/swab) were assessed in nasal swabs (NS) in sham controls and in vaccinated animals following challenge. Red lines reflect median values.

Figure 91:
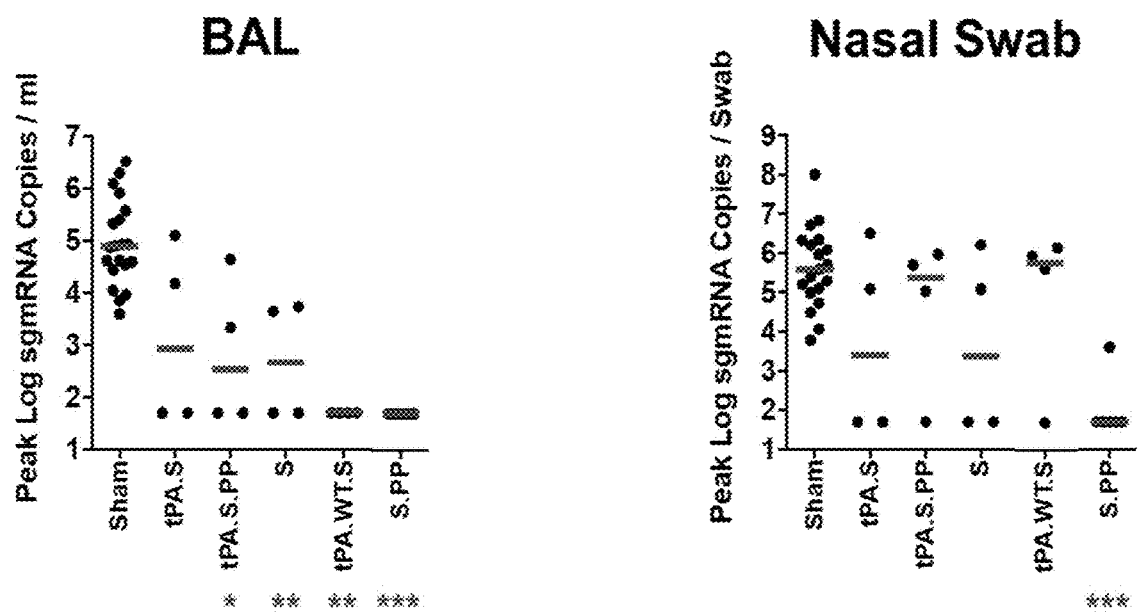

FIG. 91: Summary of peak viral loads following SARS-CoV-2 challenge. Peak viral loads in BAL and NS following challenge. Peak viral loads occurred variably on day 1-4 following challenge. Red lines reflect median viral loads. P-values indicate two-sided Mann-Whitney tests (*P<0.05, P<0.001, *P<0.0001).

Figure 92:
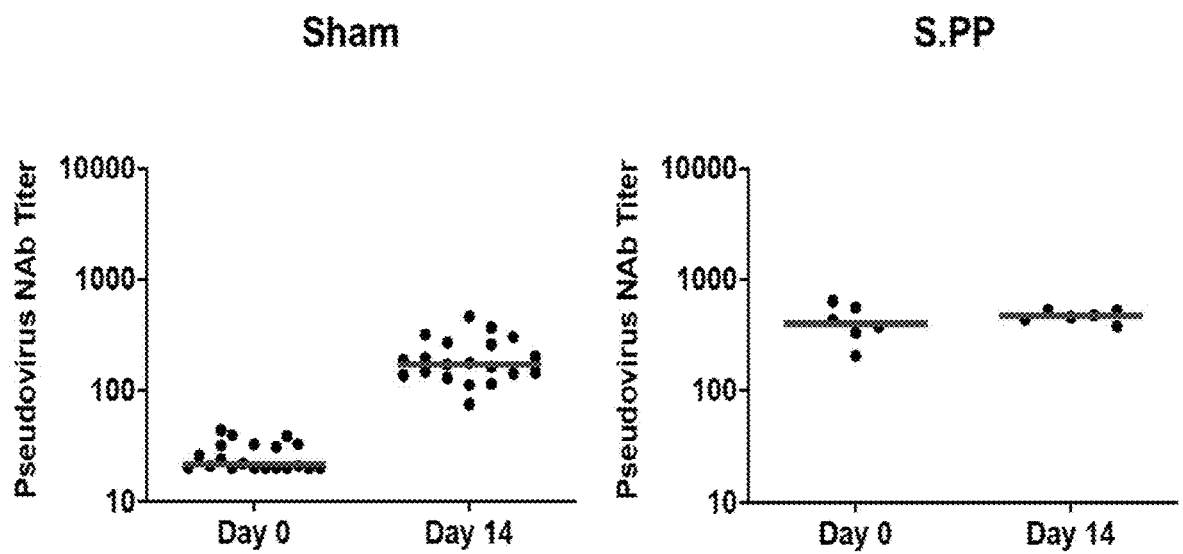

FIG. 92: Immune responses following SARS-CoV-2 challenge. Pseudovirus NAb titers prior to challenge and on day 14 following challenge. Red bars reflect median responses.

Figure 93:
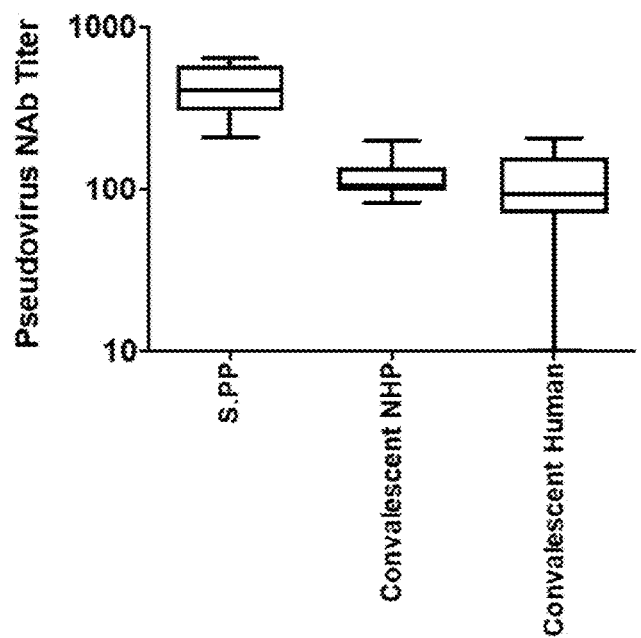

FIG. 93: Comparison of pseudovirus NAb titers in vaccinated macaques and convalescent macaques and humans. Comparison of pseudovirus NAb titers in macaques vaccinated with Ad26.S.PP with previously reported cohorts of convalescent macaques and convalescent humans who had recovered from SARS-CoV-2 infection.

Figure 94:
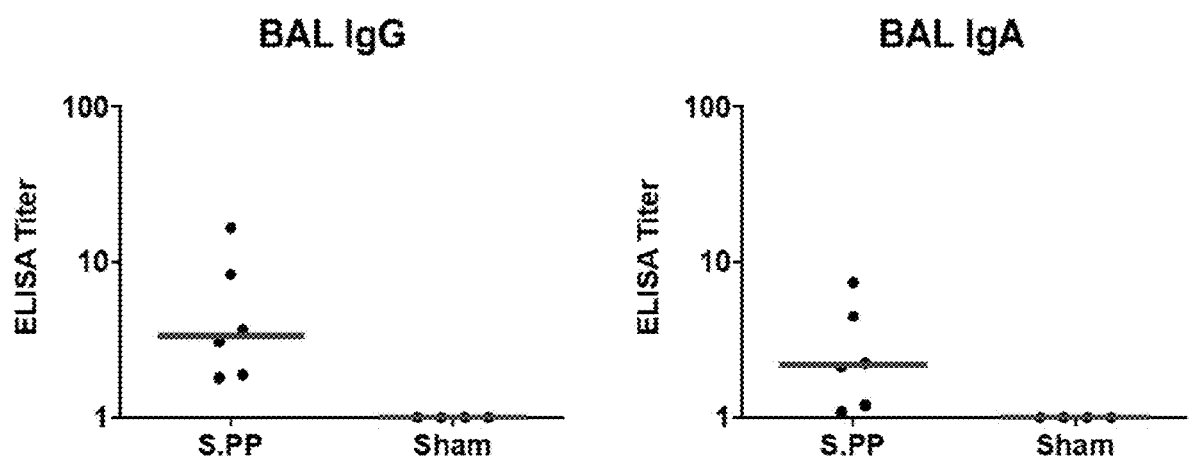

FIG. 94: Humoral immune responses in BAL in vaccinated rhesus macaques. S-specific IgG and IgA at week 4 in BAL by ELISA in sham controls and in Ad26.S.PP vaccinated animals. Red bars reflect median responses.

Figure 95:
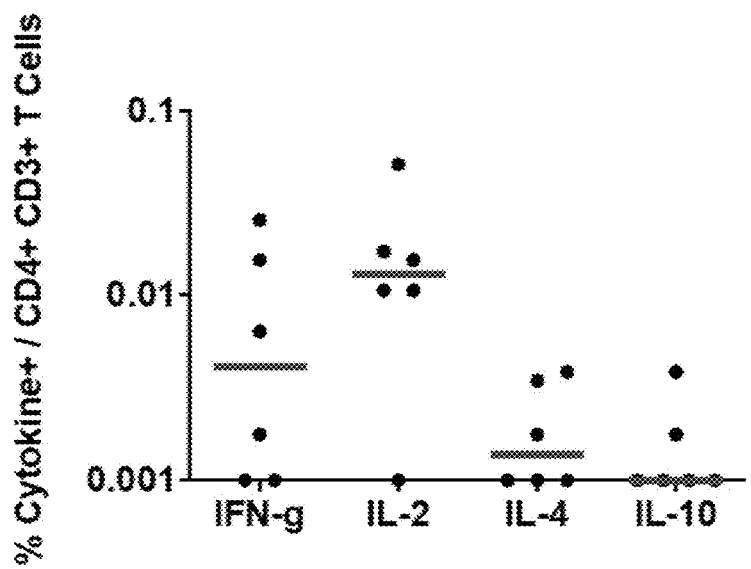

FIG. 95: Cellular immune responses in vaccinated rhesus macaques. IFN-γ+, IL-2+, IL-4+, and IL-10+CD4+ T cell intracellular cytokine staining assays in response to pooled S peptides in Ad26.S.dTM.PP and Ad26.S.PP vaccinated animals. Red bars reflect median responses.

Figure 96A:
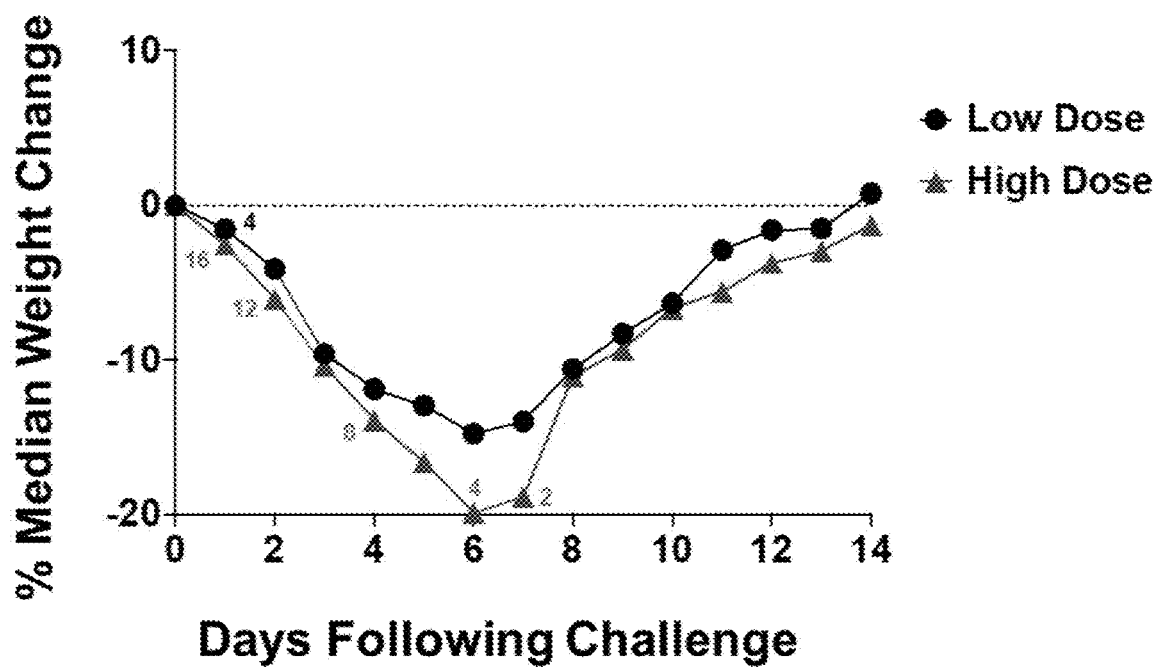
Figure 96B:
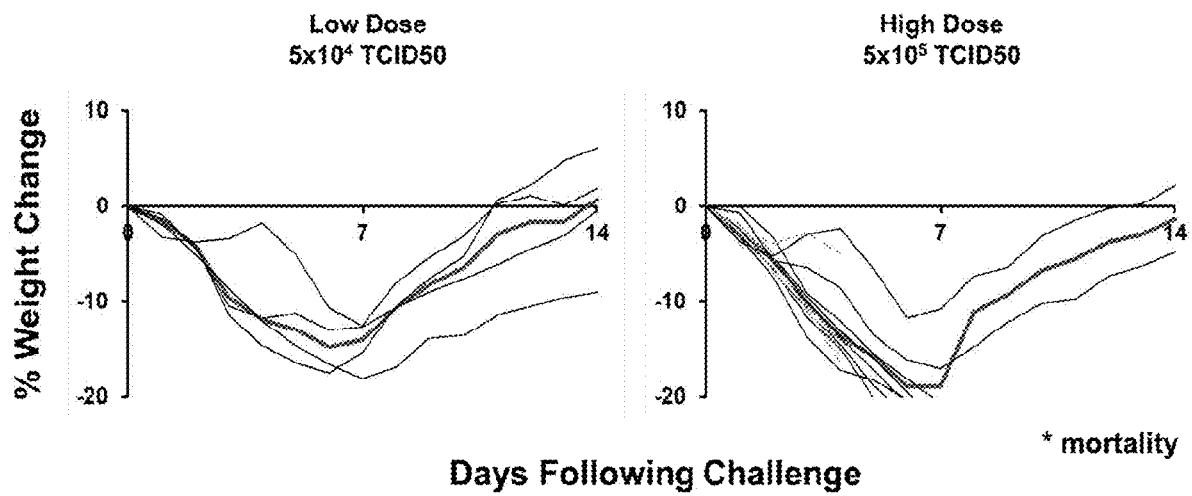
Figure 96C:
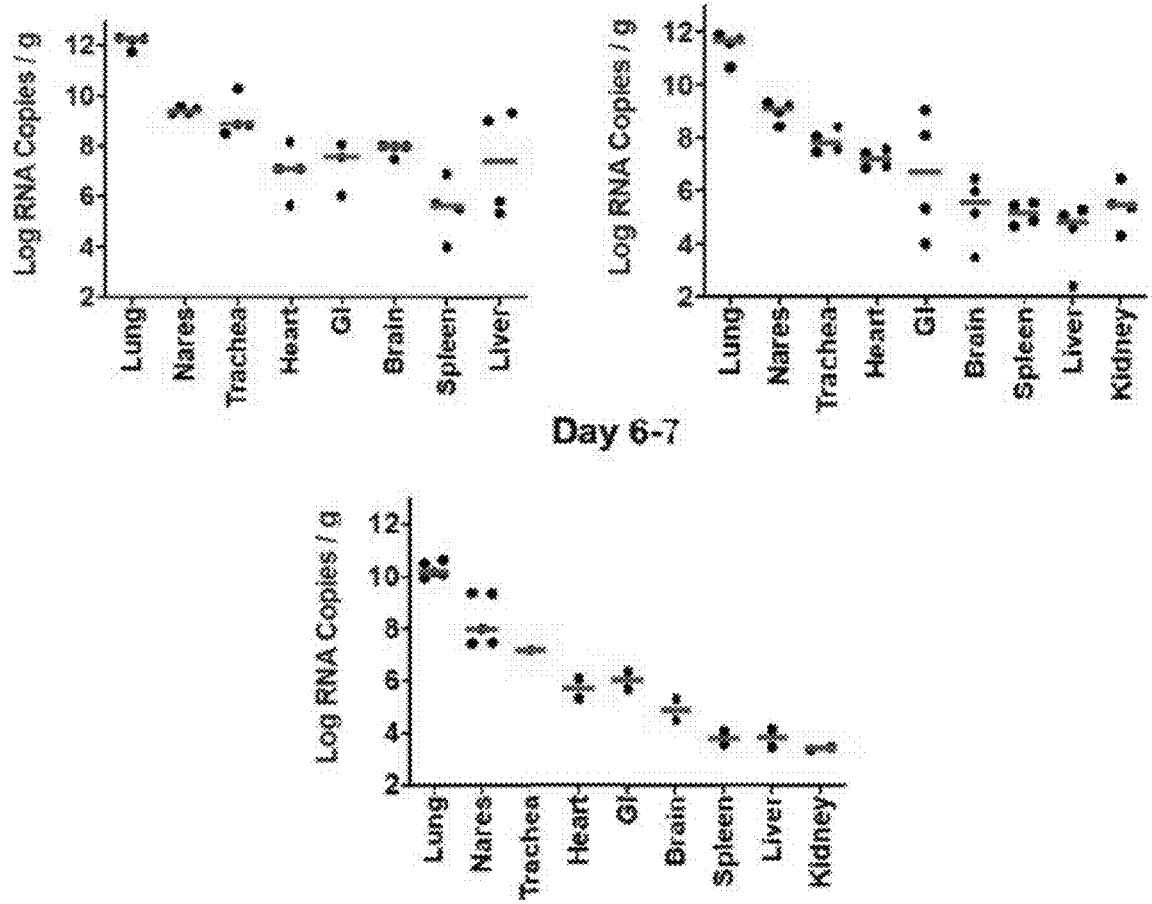

FIGS. 96A-96C: (FIG. 96A) Median percent weight change following challenge. The numbers reflect the number of animals at each timepoint. In the high-dose group, 4 animals were necropsied on day 2, 4 animals were necropsied on day 4, 4 animals met euthanization criteria on day 6, and 2 animals met euthanization criteria on day 7. (FIG. 96B) Percent weight change following challenge in individual animals. Median weight loss is depicted in red. Asterisks indicate mortality. Grey lines indicate animals with scheduled necropsies on day 2 and day 4. (FIG. 96C) Tissue viral loads as measured by $log_{10}$ RNA copies per gram tissue (limit of quantification 100 copies/g) in the scheduled necropsies at day 2 and day 4 and in 2-5 of 6 animals that met euthanization criteria on days 6-7. Extended tissues were not harvested on day 6.

FIGS. 97A-97L: Pathologic features of high-dose SARS-CoV-2 infection in hamsters. (FIG. 97A) Necrosis and inflammation (arrow) in nasal turbinate, H&E (d2). (FIG. 97B) Bronchiolar epithelial necrosis with cellular debris and degenerative neutrophils in lumen (arrow) and transmigration of inflammatory cells in vessel wall (arrowhead), H&E (d2). (FIG. 97C) Interstitial pneumonia, hemorrhage, and consolidation of lung parenchyma, H&E (d2). (FIG. 97D) Nasal turbinate epithelium shows strong positivity for SARS-CoV-N by IHC (d2). (FIG. 97E) Bronchiolar epithelium and luminal cellular debris show strong positivity for SARS-CoV-N by IHC (d2). (FIG. 97F) Pneumocytes and alveolar septa show multifocal strong positivity for SARS-CoV-N by IHC (d2). (FIG. 97G) Diffuse vRNA staining by RNAscope within pulmonary interstitium (arrow, interstitial pneumonia) and within bronchiolar epithelium (arrowhead; d2). (FIG. 97H) Diffuse vRNA staining by RNAscope within pulmonary interstitium (d4). (FIG. 97I) Iba-1 IHC (macrophages) within pulmonary interstitium (d7). (FIG. 97J) CD3+T lymphocytes within pulmonary interstitium, CD3 IHC (d4). (FIG. 97K) MPO (neutrophil myeloperoxidase) IHC indicating presence of interstitial neutrophils (d7). (FIG. 97L) Interferon-inducible gene, MX1, IHC shows strong and diffuse positivity throughout the lung (d4). H&E, hematoxylin and eosin; IHC, immunohistochemistry; Iba1, ionized calcium binding adaptor protein 1. Representative sections are shown. Experiments were repeated at least 3 times with similar results. Scale bars=20 μm (b, d); 50 μm (a, e, f); 100 μm (c, g-l).

FIGS. 98A-98F: Humoral immune responses in vaccinated hamsters. (FIG. 98A) SARS-CoV-2 spike (S) immunogens with (i) deletion of the transmembrane region and cytoplasmic tail reflecting the soluble ectodomain with a foldon trimerization domain (S.dTM.PP) or (ii) full-length S (S.PP), both with mutation of the furin cleavage site and two proline stabilizing mutations. Red X depicts furin cleavage site mutation, red vertical lines depict proline mutations, open square depicts foldon trimerization domain. S1 and S2 represent the first and second domain of the S protein, TM depicts the transmembrane region, and CT depicts the cytoplasmic domain. Hamsters were vaccinated with $10^{10}$ vp or $10^9$ vp of Ad26-S.dTM.PP or Ad26-S.PP or sham controls (N=10/group). Humoral immune responses were assessed at weeks 0, 2, and 4 by (FIG. 98B) RBD-specific binding antibody ELISA and (FIG. 98C) pseudovirus neutralization assays. Red bars reflect median responses. Dotted lines reflect assay limit of quantitation. (FIG. 98D) S- and RBD specific IgG subclass, FcγR, and ADCD responses at week 4 are shown as radar plots. The size and color intensity of the wedges indicate the median of the feature for the corresponding group (antibody subclass, red; FcγR binding, blue; ADCD, green). (FIG. 98E) Principal component analysis (PCA) plot showing the multivariate antibody profiles across vaccination groups. Each dot represents an animal, the color of the dot denotes the group, and the ellipses show the distribution of the groups as 70% confidence levels assuming a multivariate normal distribution. (FIG. 98F) The heat map shows the differences in the means of z-scored features between vaccine groups S.PP and S.dTM.PP. The two groups were compared by two-sided Mann-Whitney tests and stars indicate the Benjamini-Hochberg corrected q-values (*q<0.05,  q<0.01, * q<0.001).

Figure 99A:
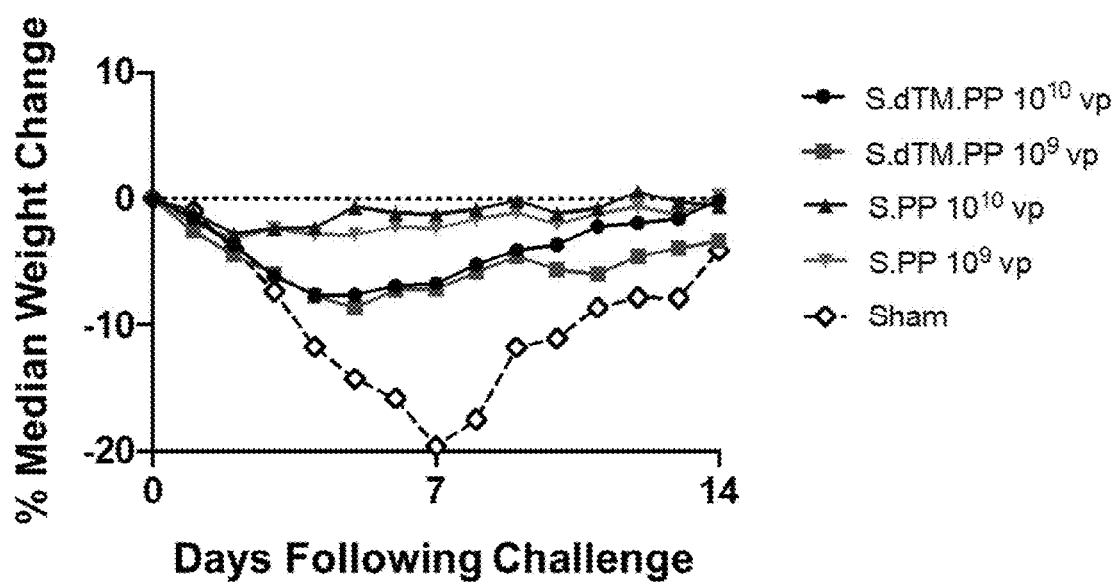
Figure 99B:
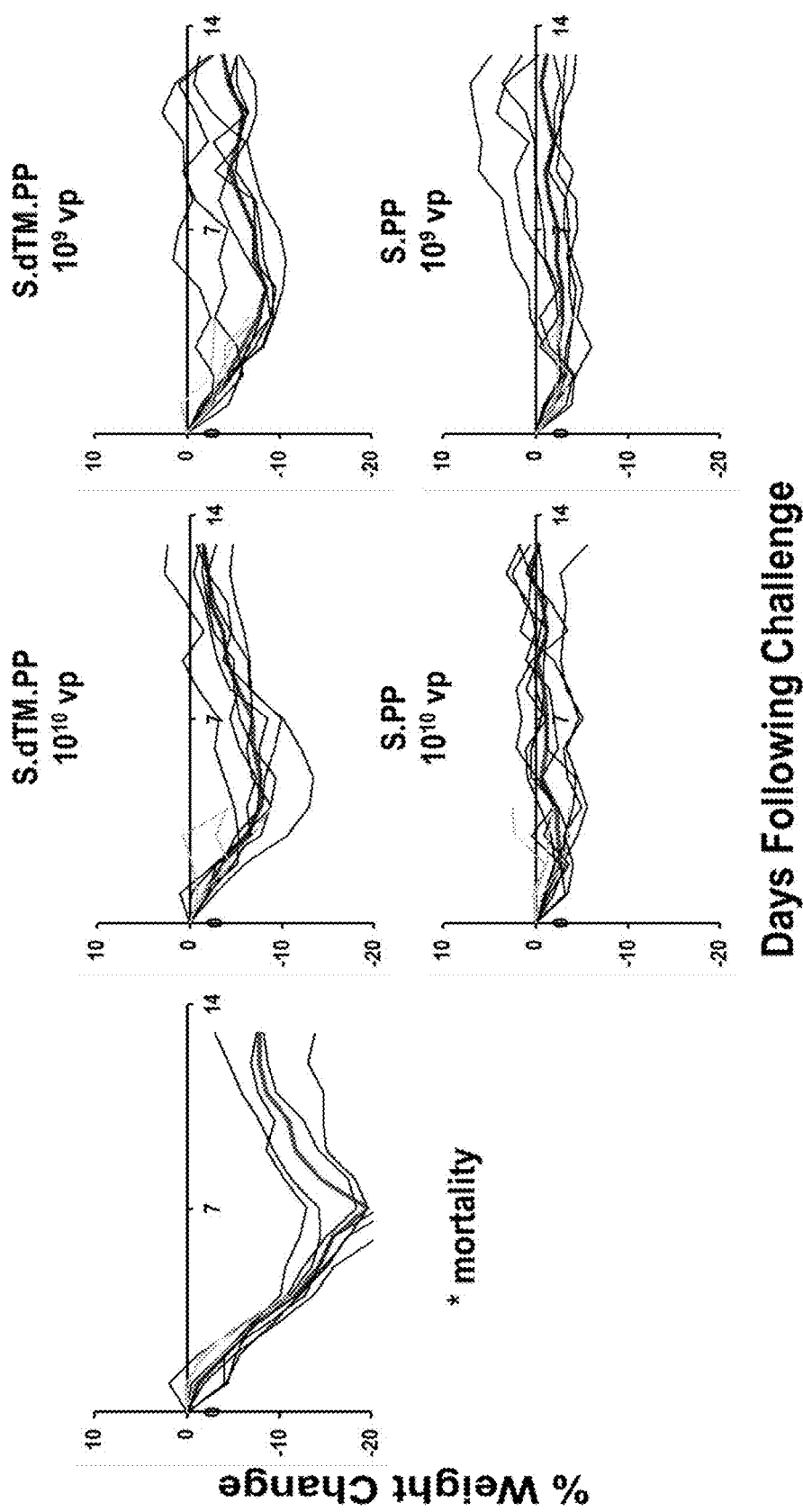
Figure 99C:
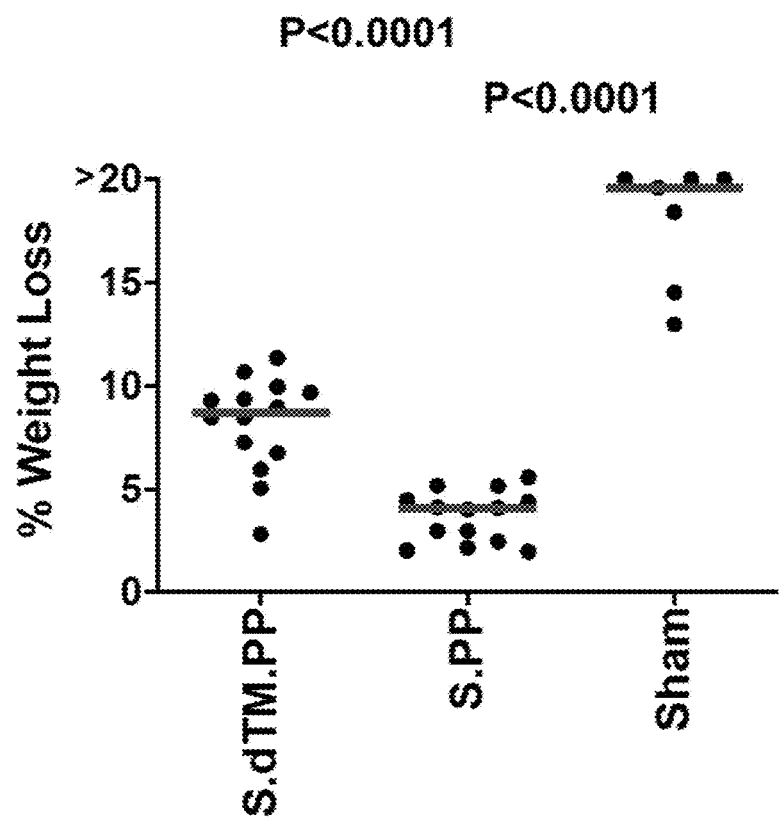
Figure 100A:
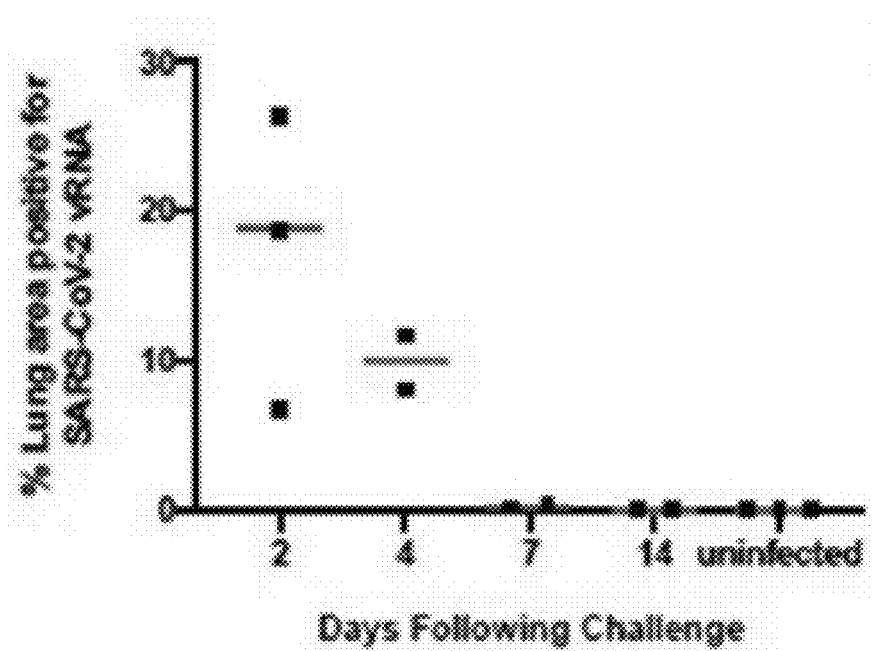
Figure 100B:
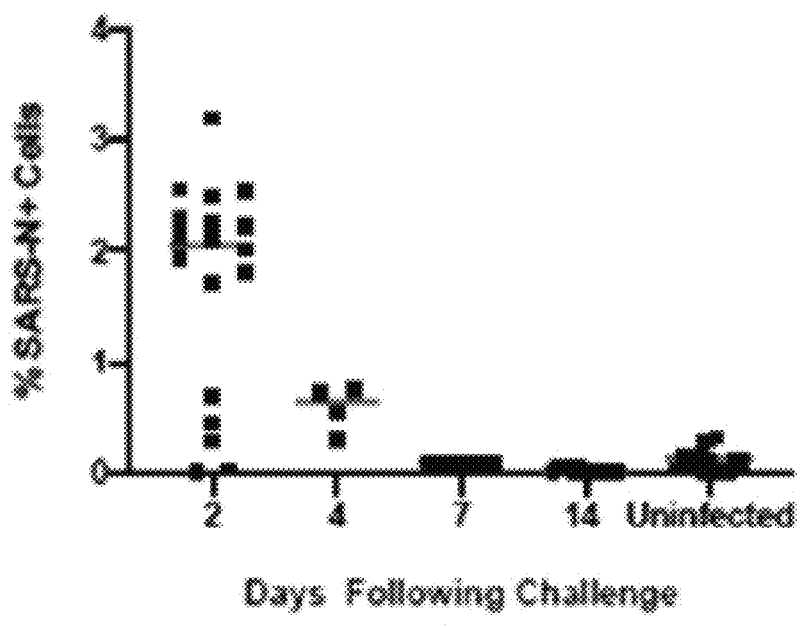
Figure 100C:
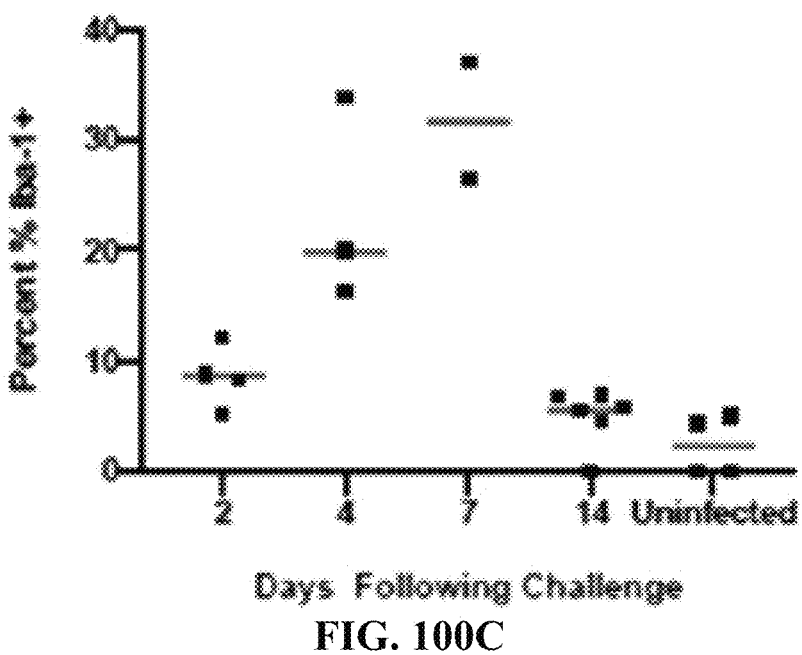
Figure 100D:
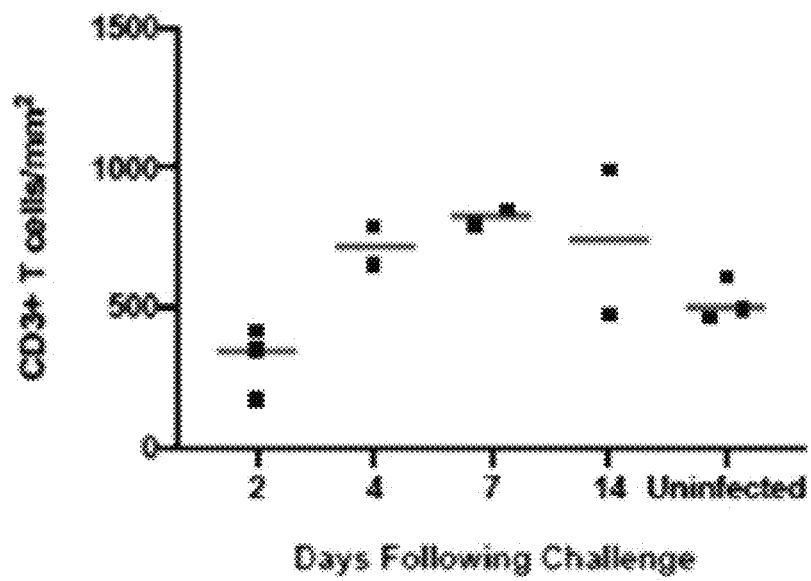
Figure 100E:
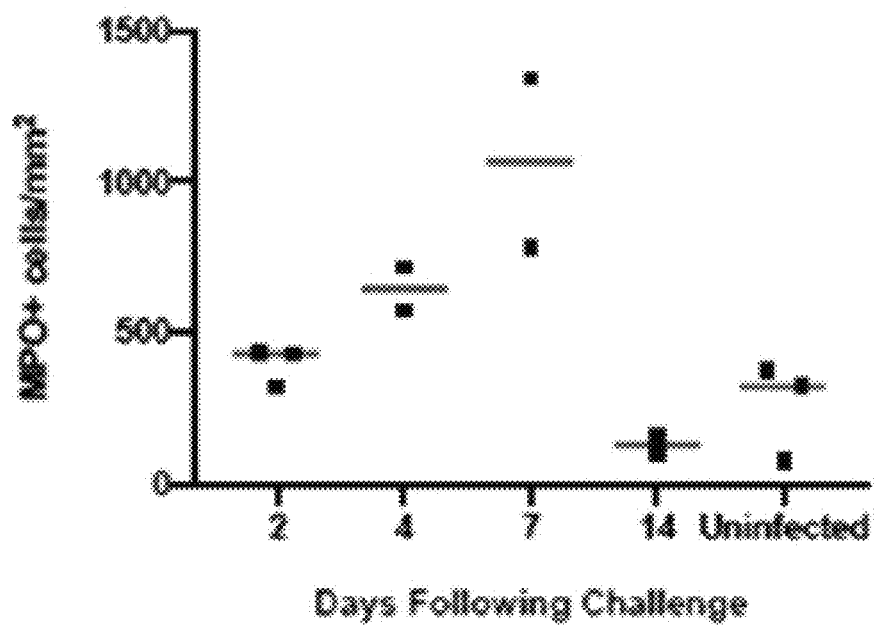
Figure 100F:
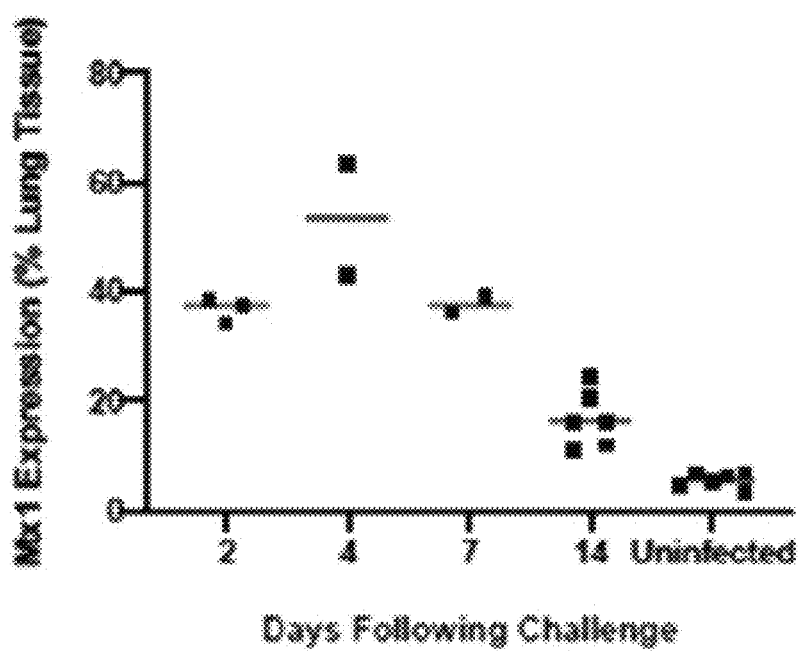

FIGS. 99A-99C: Clinical disease in hamsters following high-dose SARS-CoV-2 challenge. (FIG. 99A) Median percent weight change following challenge. (FIG. 99B) Percent weight change following challenge in individual animals. Median weight loss is depicted in red. Asterisks indicate mortality. Grey lines indicate animals with scheduled necropsies on day 4. (FIG. 99C) Maximal weight loss in the combined Ad26-S.dTM.PP (N=14), Ad26-S.PP (N=14), and sham control (N=7) groups, excluding the animals that were necropsied on day 4. P values indicate two-sided Mann Whitney tests. N reflects all animals that were followed for weight loss and were not necropsied on day 4.

FIGS. 100A-100F: Longitudinal quantitative image analysis of viral replication and associated inflammation in lungs. (FIG. 100A) Percent lung area positive for anti-sense SARS-CoV-2 viral RNA (vRNA) by RNAscope ISH. (FIG. 100B) Percentage of total cells positive for SARS-CoV-N protein (nuclear or cytoplasmic) by IHC. (FIG. 100C) Iba-1 positive cells per unit area by IHC. (FIG. 100D) CD3 positive cells per unit area. (FIG. 100E) MPO positive cells per unit area. (FIG. 100F) Percentage of MX1 positive lung tissue as a proportion of total lung area. ISH, in situ hybridization; IHC, immunohistochemistry; SARS-N, SARS-CoV nucleocapsid; MPO, myeloperoxidase; MX1, myxovirus protein 1 (a type 1 interferon inducible gene). Each dot represents one animal.

FIG. 101: Participants were enrolled concurrently at Belgian and US sites. Participants were randomized in parallel in a 1:1:1:1:1 ratio to one of five vaccination groups to receive one or two IM injections of Ad26.COV2.S at two dose levels of either $5\times10^{10}$ vp or $1\times10^{11}$ vp, or placebo. For each cohort, in the absence of clinically significant findings 24 hours after the first vaccination was administered to five sentinel participants (one per dose level and one placebo), another ten participants were vaccinated across all groups. Safety data up to day 28 were then reviewed by an internal data review committee before the remaining participants were randomized.

Figure 102A:
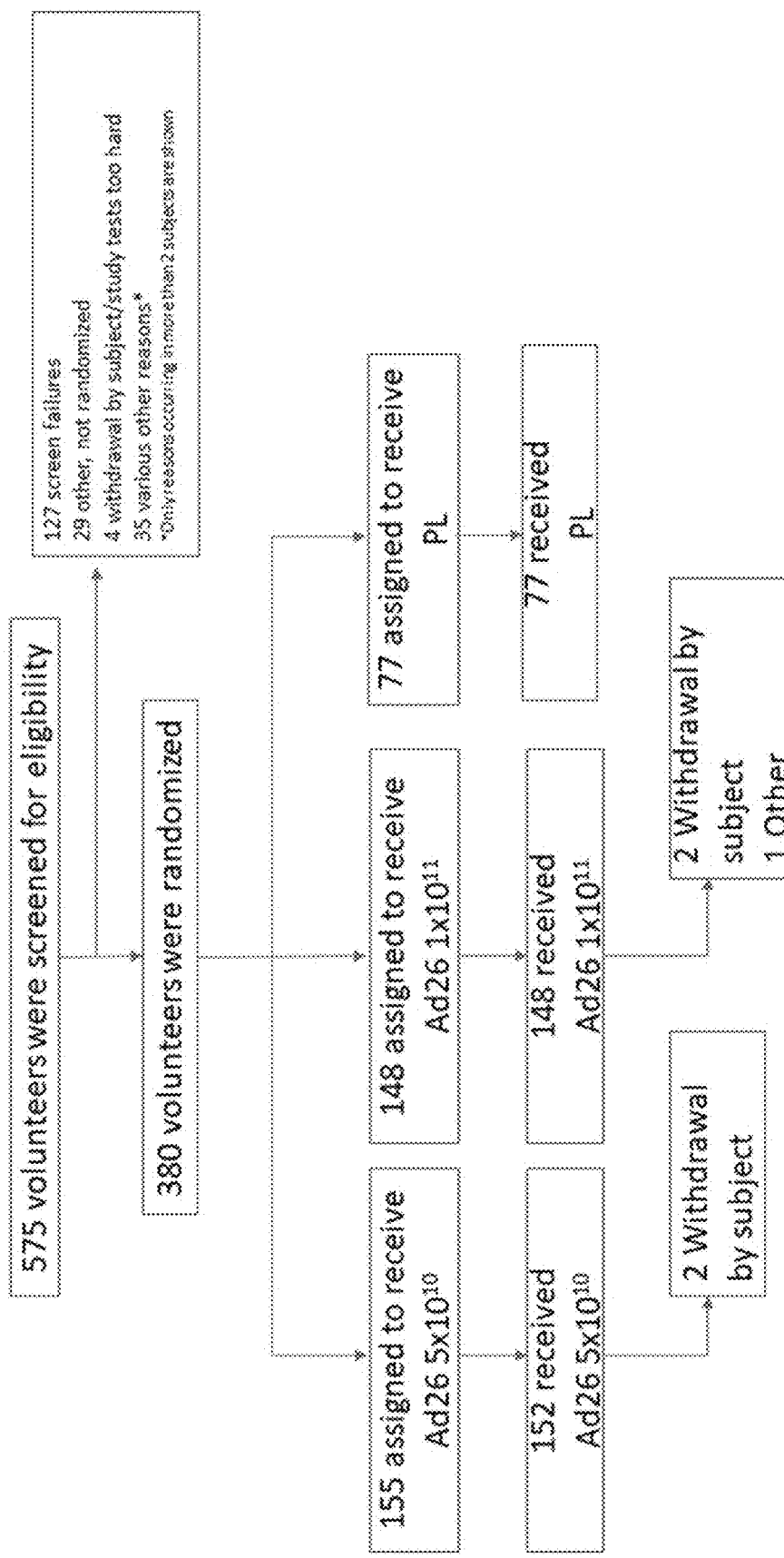
Figure 102B:
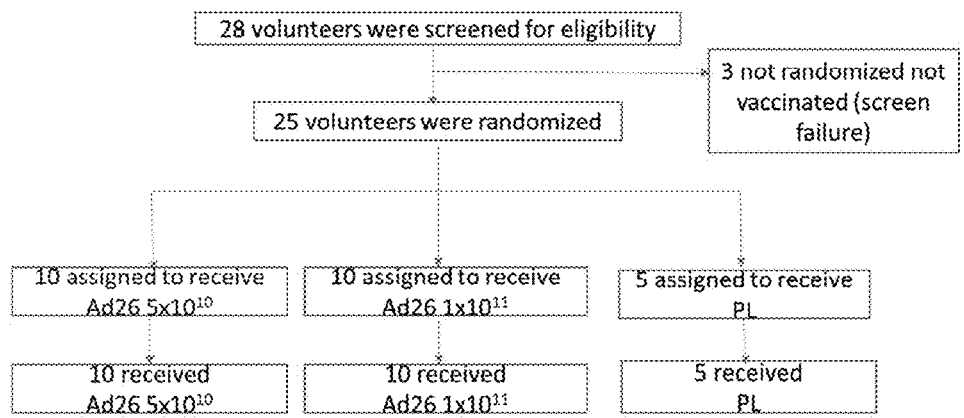
Figure 102C:
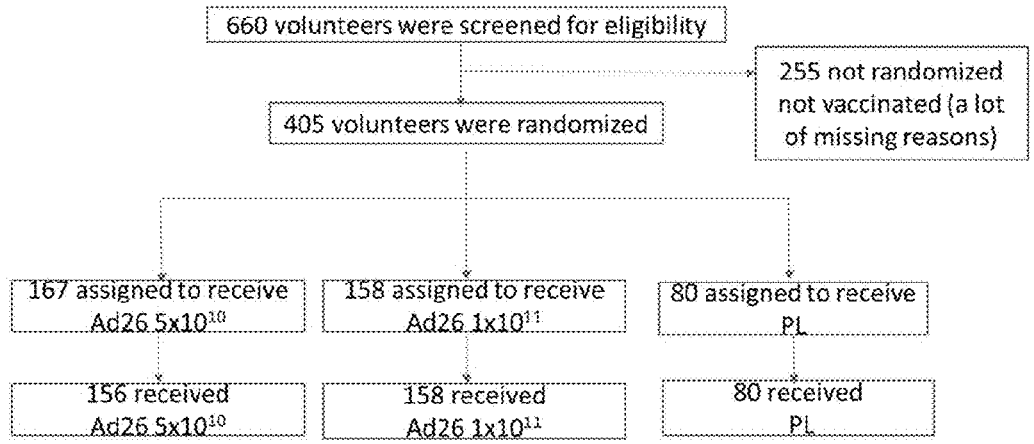

FIGS. 102A-102C: Flow charts for cohort 1a (FIG. 102A), cohort 1b (FIG. 102B) and cohort 3 (FIG. 102C).

FIGS. 103A-103D: Humoral and cellular immune responses. (FIG. 103A) Log geometric mean titers (GMTs—as illustrated by the horizontal bars and the numbers below each timepoint) of serum SARS-CoV-2 binding antibodies, measured by ELISA (ELISA Units per mL [EU/mL]), at baseline and 29 days post vaccination, among all participants, according to schedule in cohort 1a and 3. Dotted lines indicate the lower limit of quantification (LLOQ) and upper limit of quantification (ULOQ) of the assay, error bars indicate 95% confidence interval (CI). For values below the LLOQ, LLOQ/2 values were plotted. (FIG. 103B) Log GMTs of serum SARS-CoV-2 neutralizing antibodies, measured by 50% microneutralization assay ($ID_{50}$ Log GMT—as illustrated by the horizontal bars and the numbers below each timepoint), at baseline and 29 days post vaccination, among a subset of participants, according to schedule, in cohort 1a and 3. Dotted lines indicate the LLOQ and ULOQ of the assay, error bars indicate 95% CI. For values below the LLOQ, LLOQ/2 values were plotted. (FIG. 103C) Expression of Th1 (IFNγ and/or IL-2, not IL-4, IL-5 and IL-13), and Th2 (IL-4 and/or IL-5 and/or IL-13 and CD40L) cytokines by CD4 T cells was measured by intracellular cytokine staining (ICS). Median (as illustrated by the horizontal bars and the numbers below each timepoint) and individual ICS responses to SARS-CoV-2 S protein peptide pool in peripheral blood mononuclear cells, at baseline and 15 days post vaccination, among a subset of participants from cohort 1a and 3, according to schedule. Percent denotes the percentage of T cells positive for the Th1 or Th2 cytokines. Dotted line indicates the LLOQ. (FIG. 103D) Expression of IFNγ and/or IL-2 cytokines by CD8 T cells was measured by ICS. Median (as illustrated by the horizontal bars and the numbers below each timepoint) and individual ICS responses to SARS-CoV-2 S protein peptide pool in peripheral blood mononuclear cells, at baseline and 15 days post vaccination, among a subset of participants from cohort 1a and 3, according to schedule. Percent denotes the percentage of CD8 T cells positive for IFNγ and/or IL-2 cytokines. Dotted line indicates the LLOQ.

Figure 104:
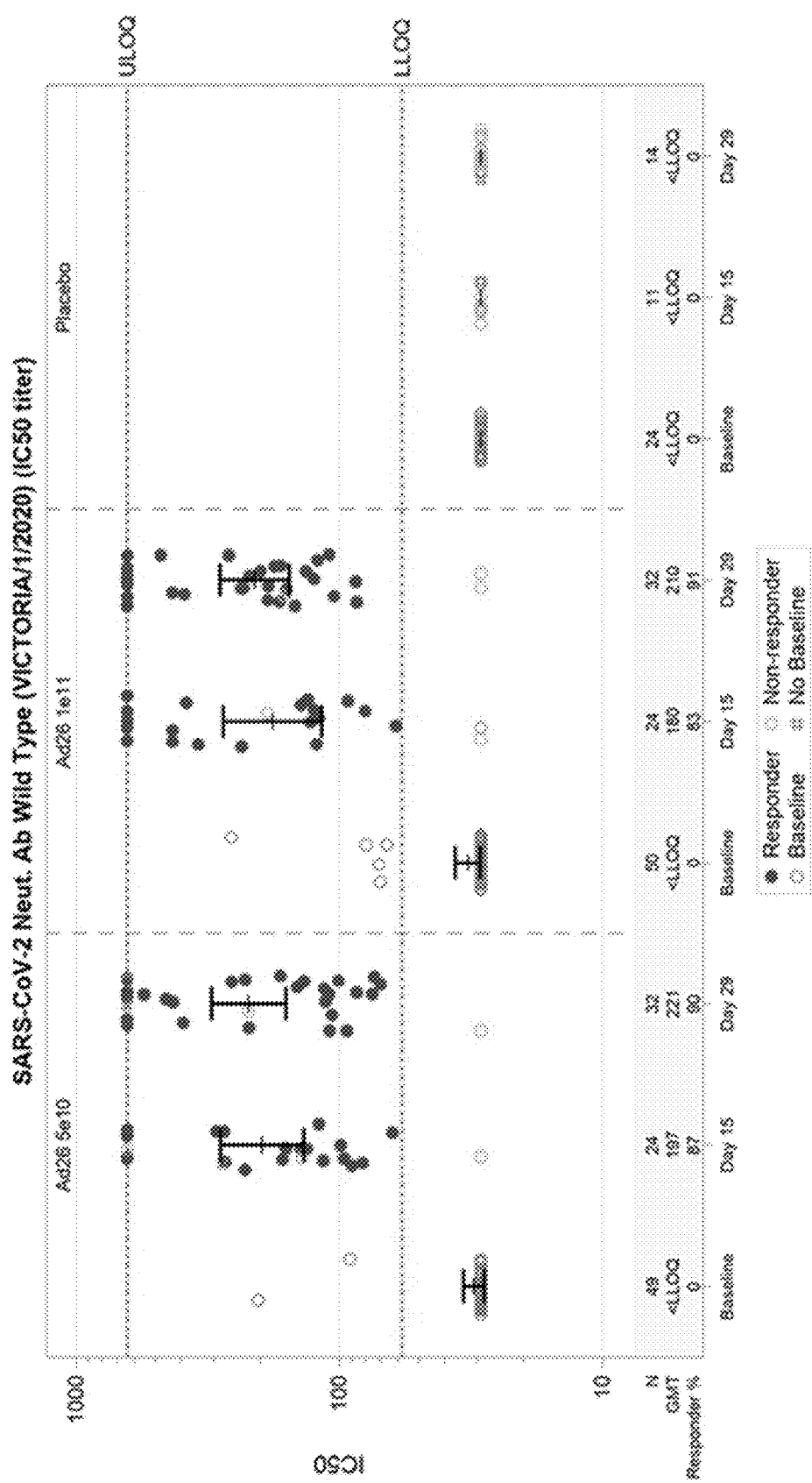

FIG. 104: Graphical representation of VNA responses against SARS-CoV-2 (geometric mean titers [GMTs] with corresponding 95% CIs) over time.

Figure 105:
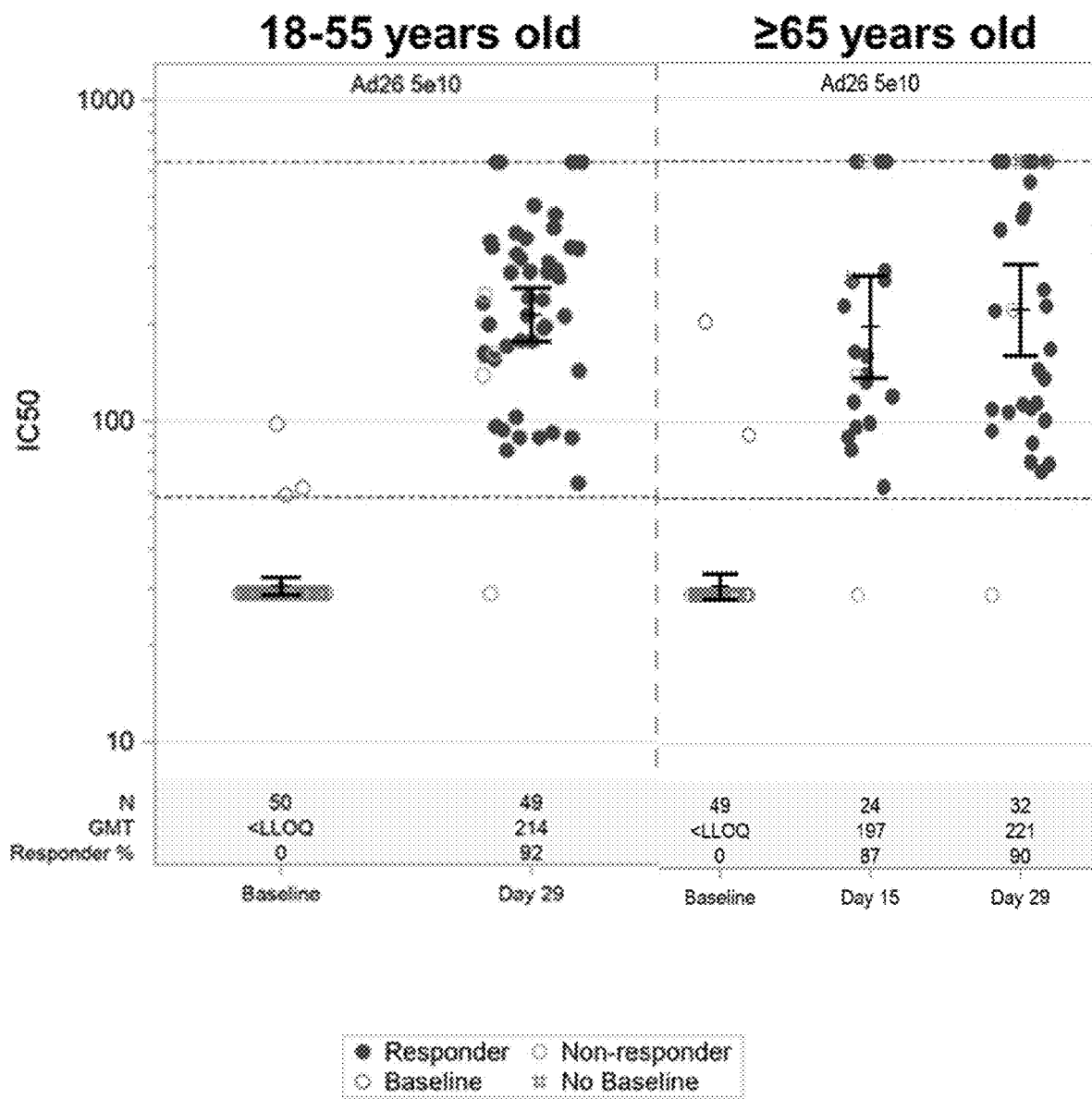

FIG. 105: depicts the effect of age on the neutralizing antibody response by Day 29.

Figure 106:
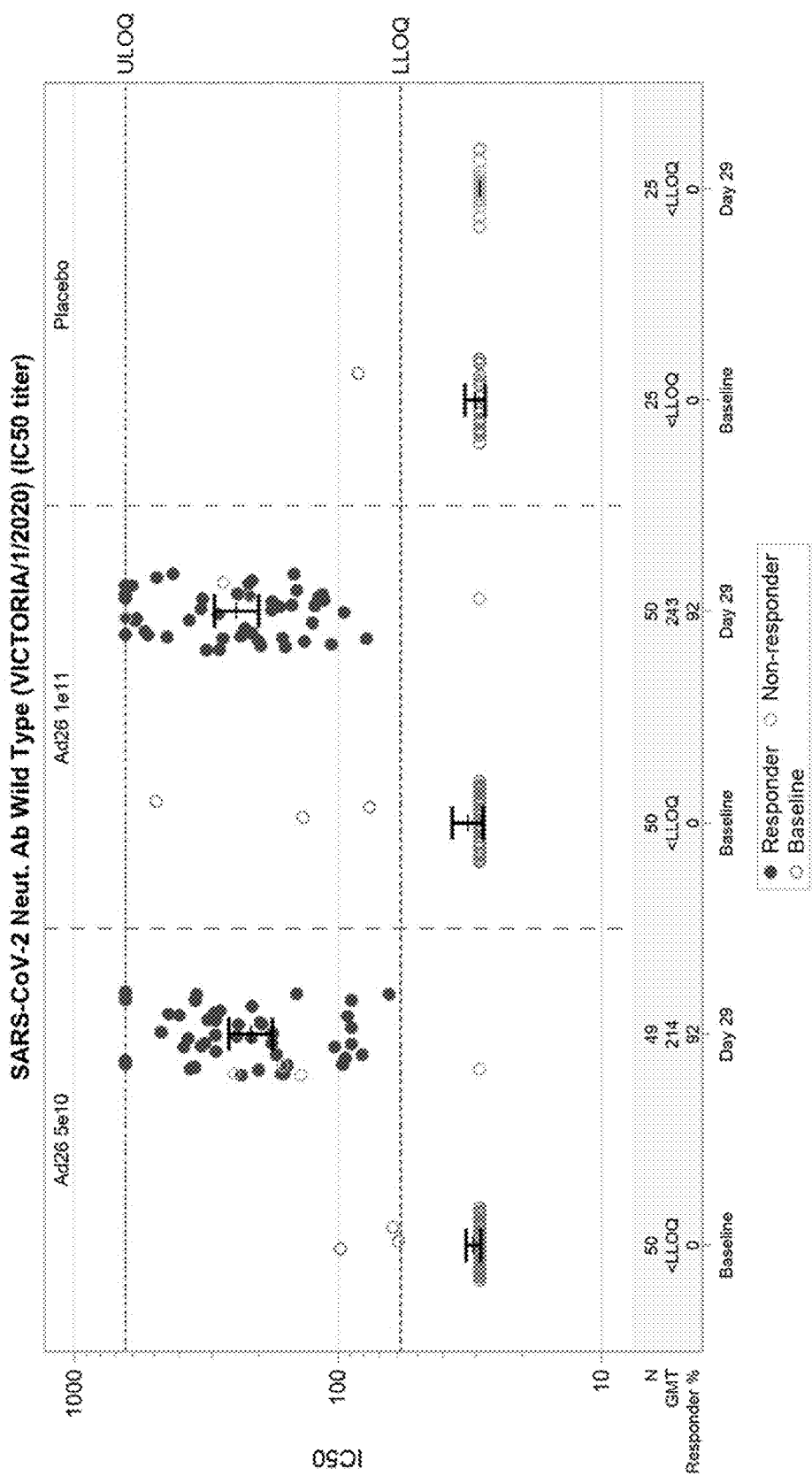

FIG. 106: depicts the neutralizing antibody response and responder rates in the study cohorts.

FIG. 107: depicts reverse cumulative distribution curves for the $5\times10^{10}$ vp vaccine group and the $1\times10^{11}$ vp vaccine group.

Figure 108:
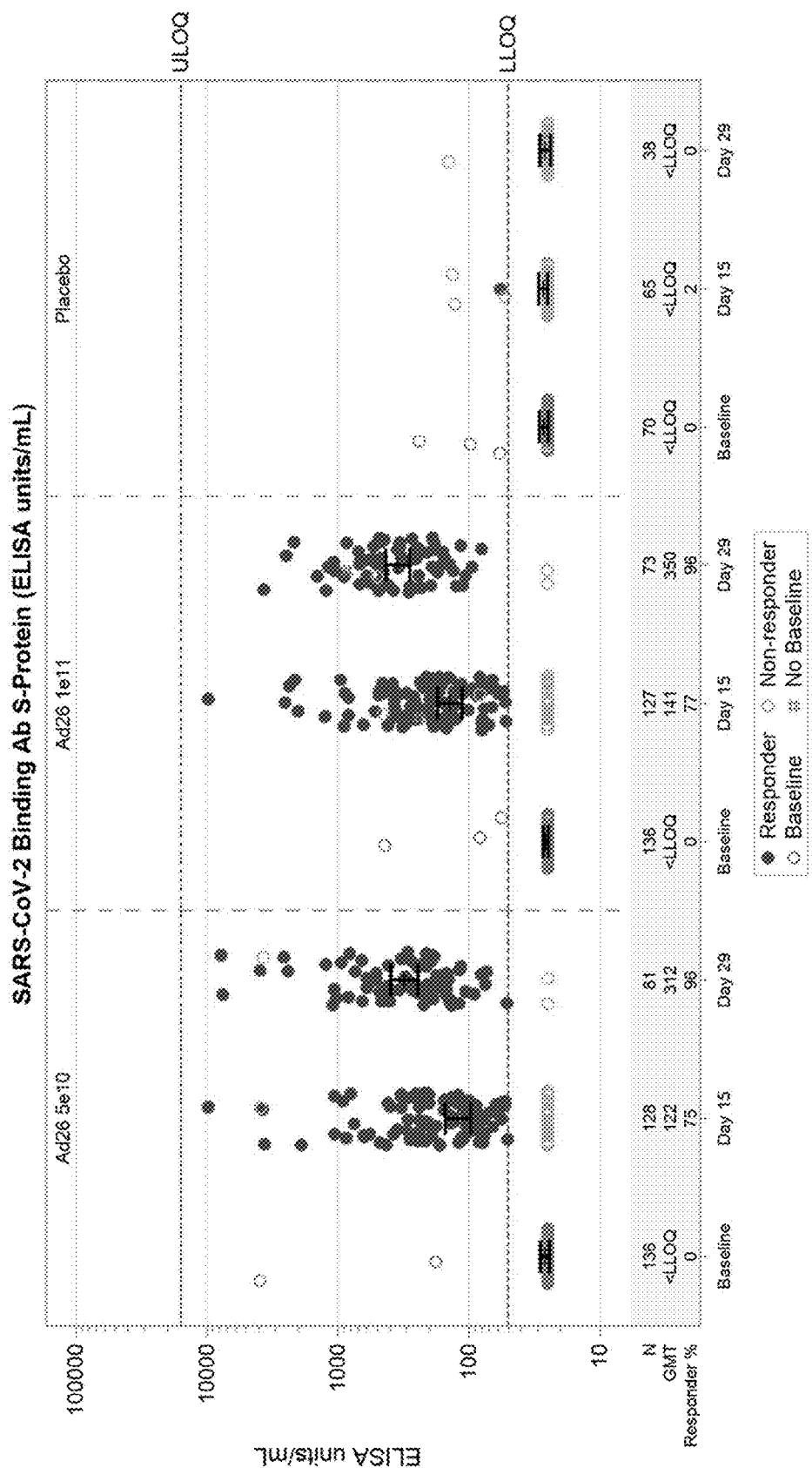

FIG. 108: graphic representation of SARS-CoV-2 S protein binding antibody responses as measured by ELISA.

Figure 109:
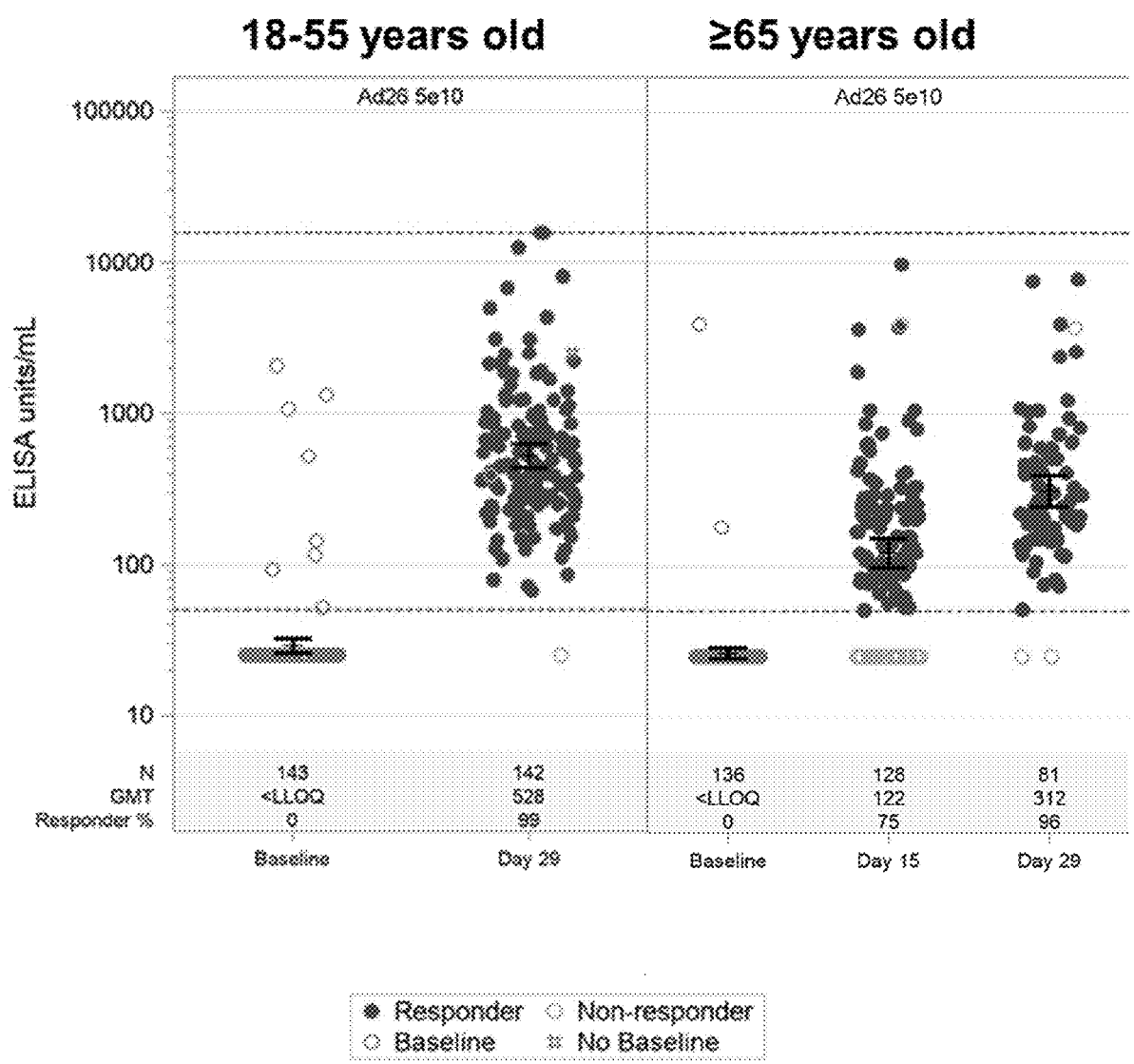

FIG. 109: depicts the effect of age on the binding antibody response at Day 29.

Figure 110:
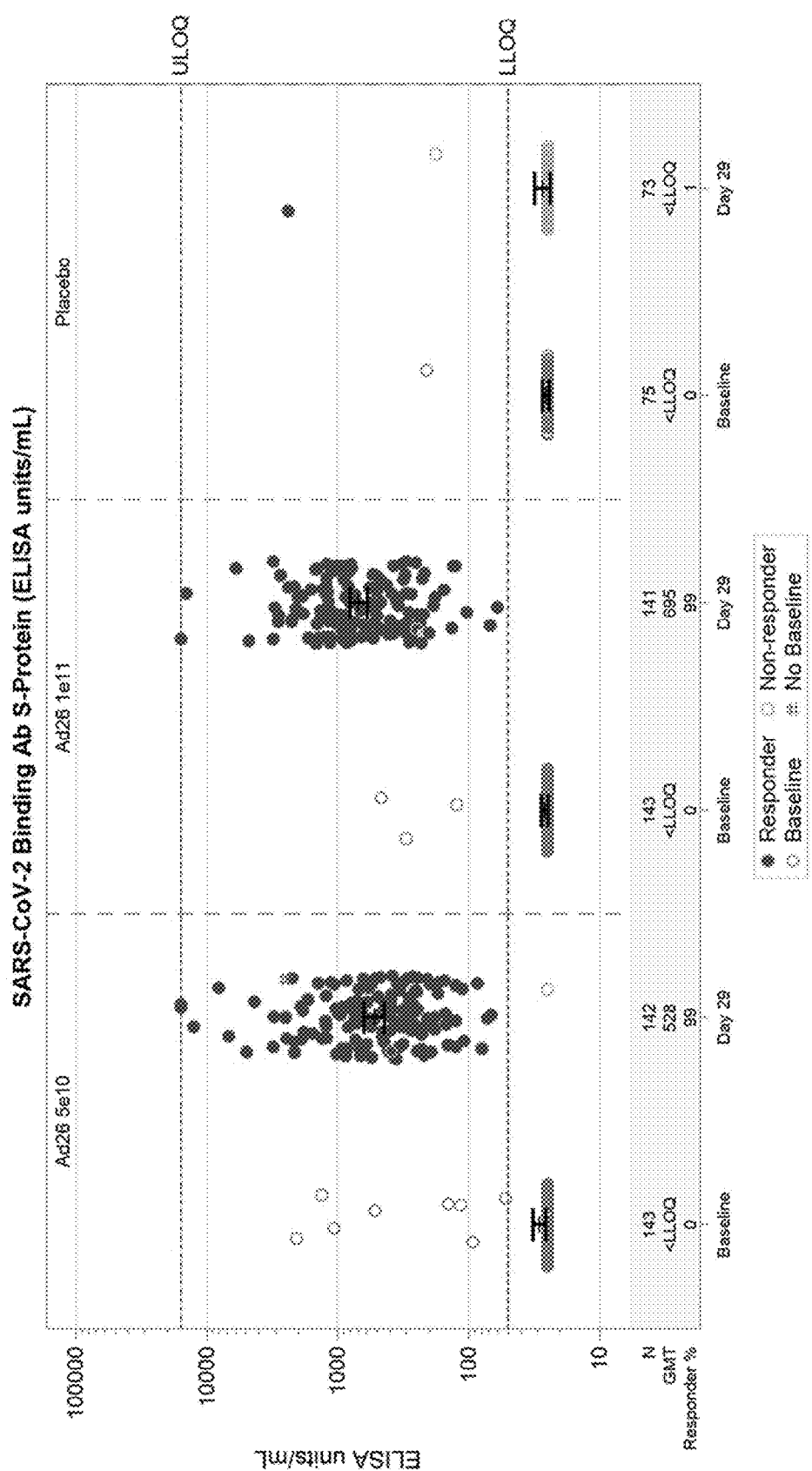

FIG. 110: graphic representation of SARS-CoV-2 S protein binding antibody responses as measured by ELISA.

Figure 111:
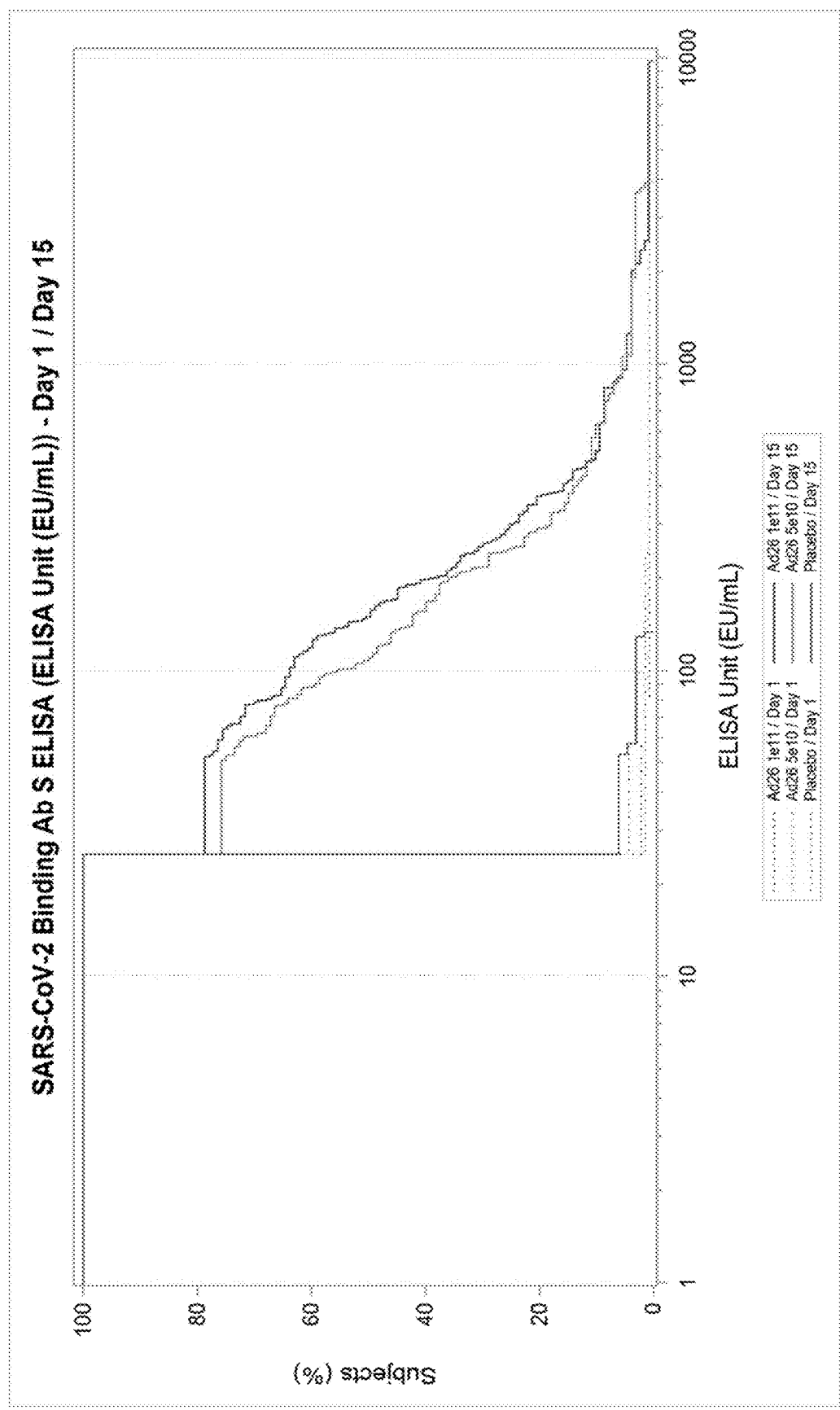

FIG. 111: depicts reverse cumulative distribution curves for the $5\times10^{10}$ vp vaccine group and the $1\times10^{11}$ vp vaccine group.

Figure 112:
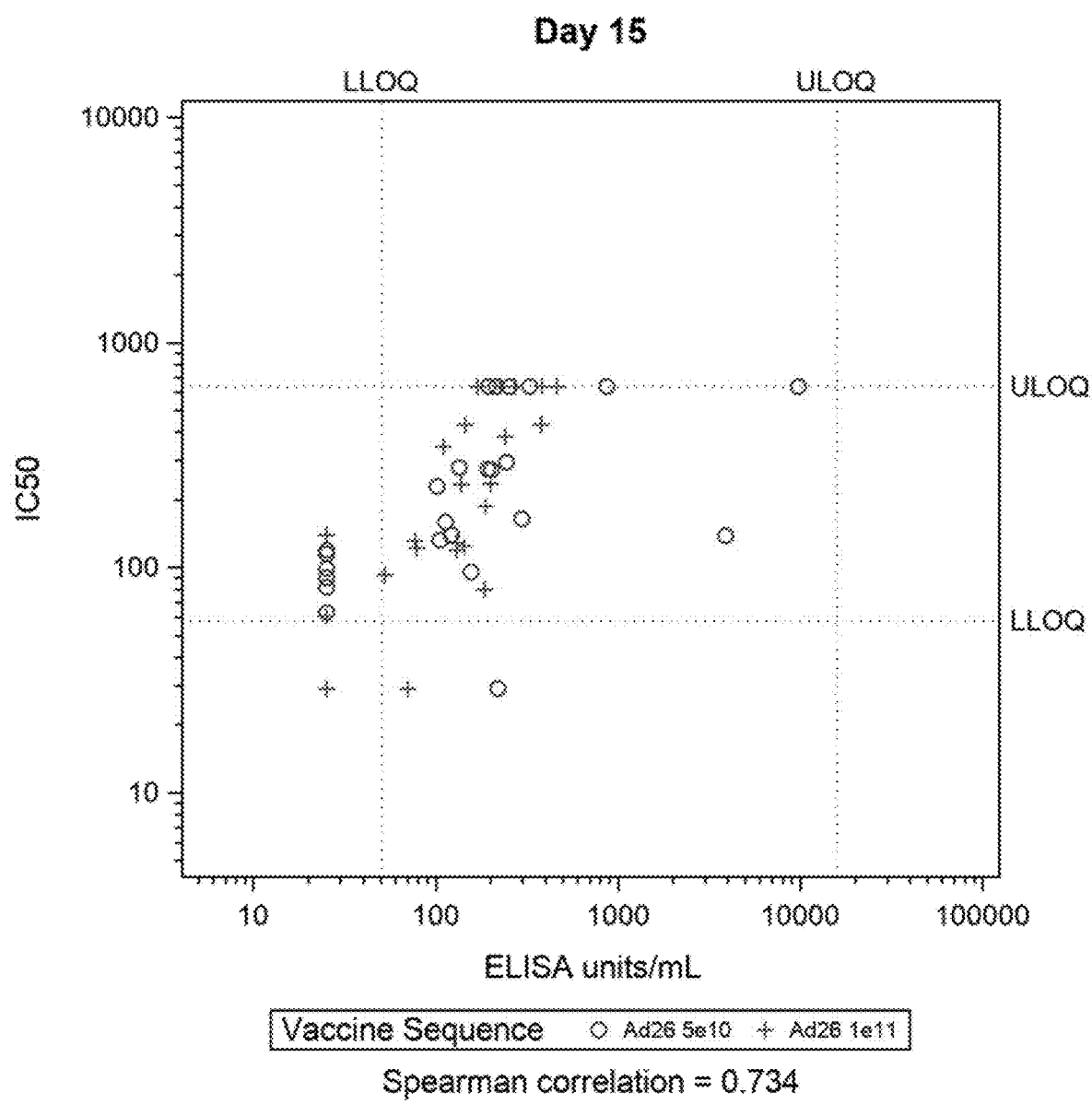

FIG. 112: shows that wtVNA titers highly correlated with ELISA titers at both Day 15 and Day 29, with Spearman Correlation coefficients of 0.734 and 0.72; respectively.

Figure 113:
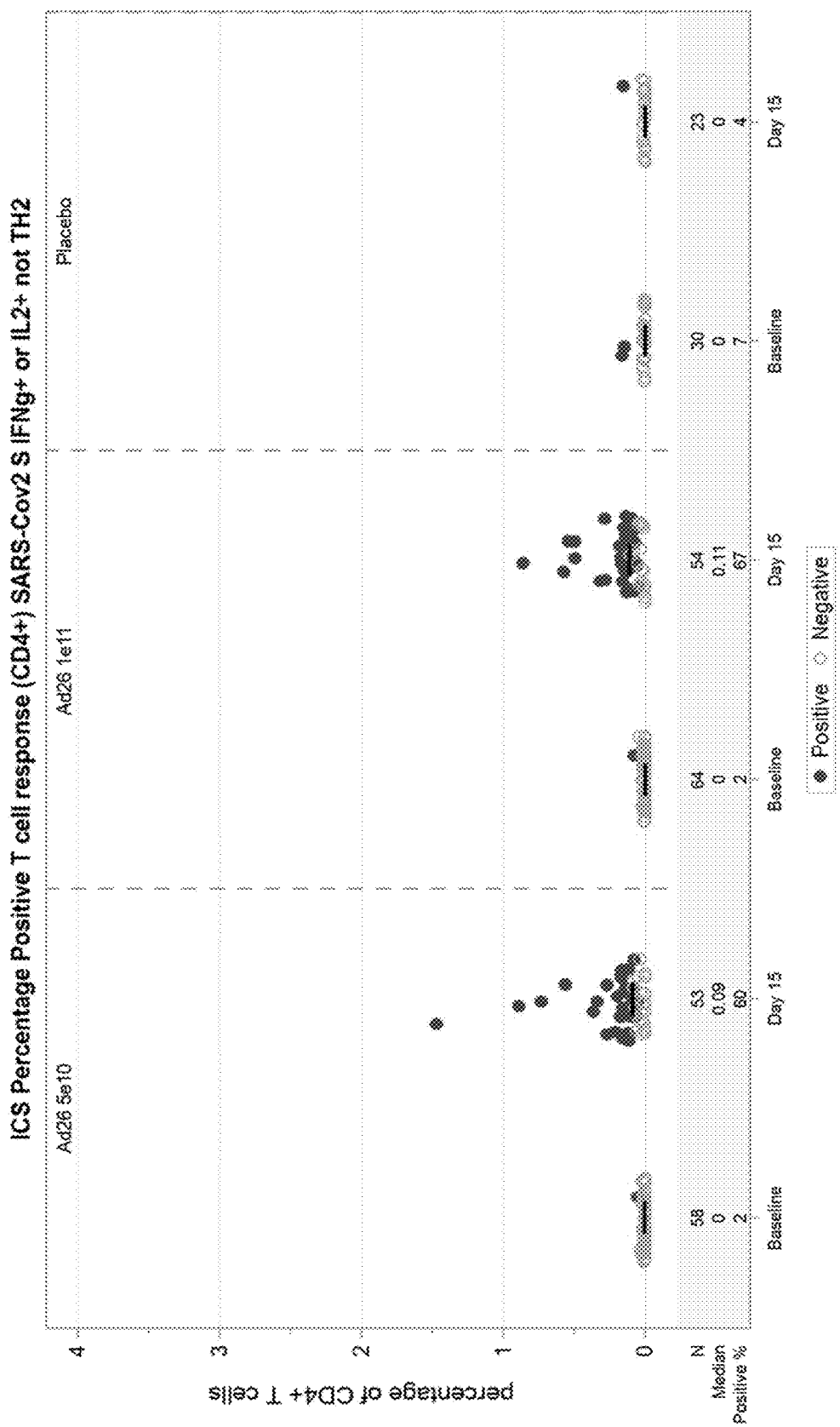

FIG. 113: shows the percentage of CD4+ T cells expressing IFNγ and/or IL-2 (Th1), and not Th2 cytokines, and expressing IL-4 and/or IL-5/IL-13 and CD40L (Th2).

Figure 114:
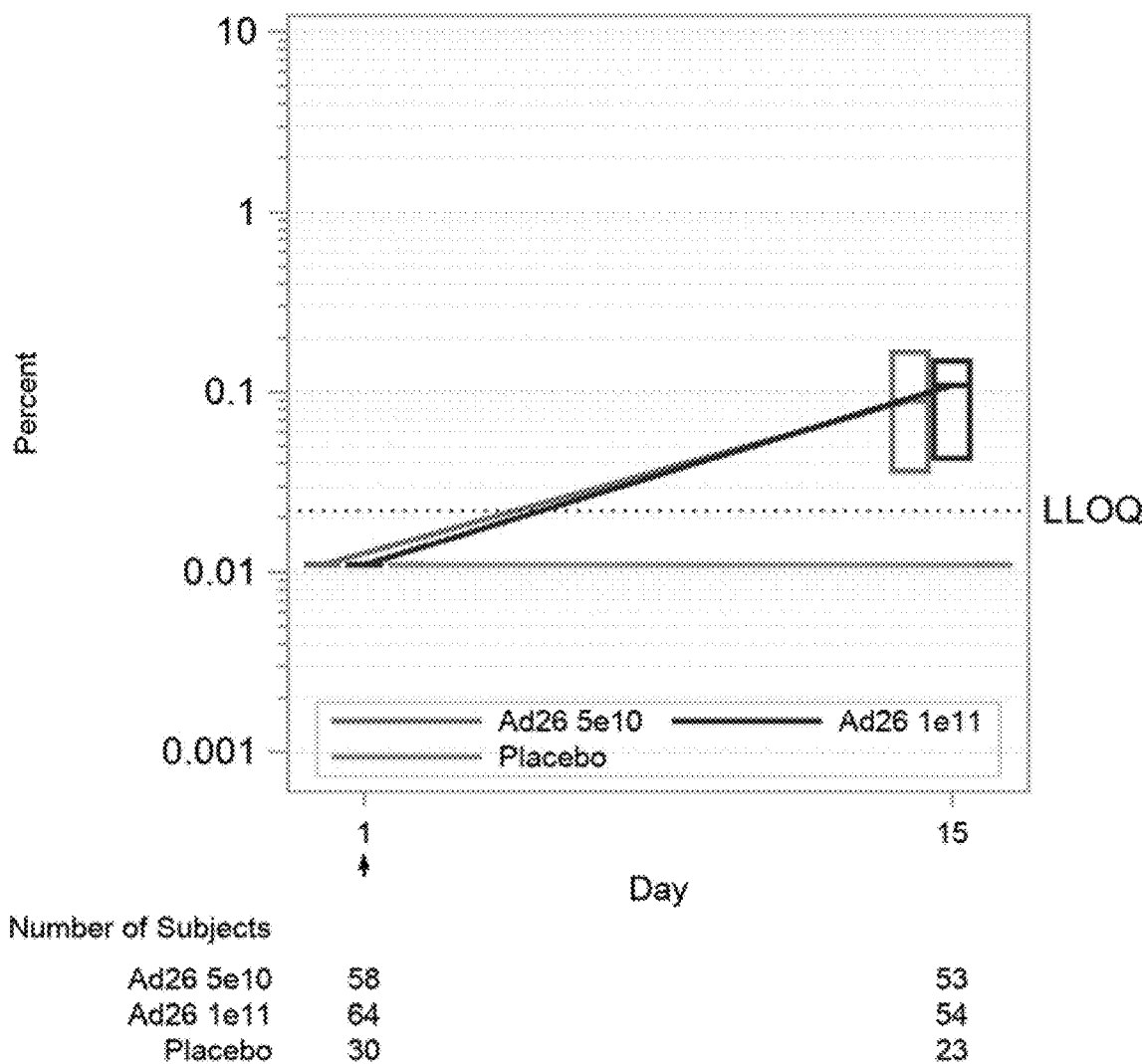

FIG. 114: shows the combined regimen profile.

Figure 115:
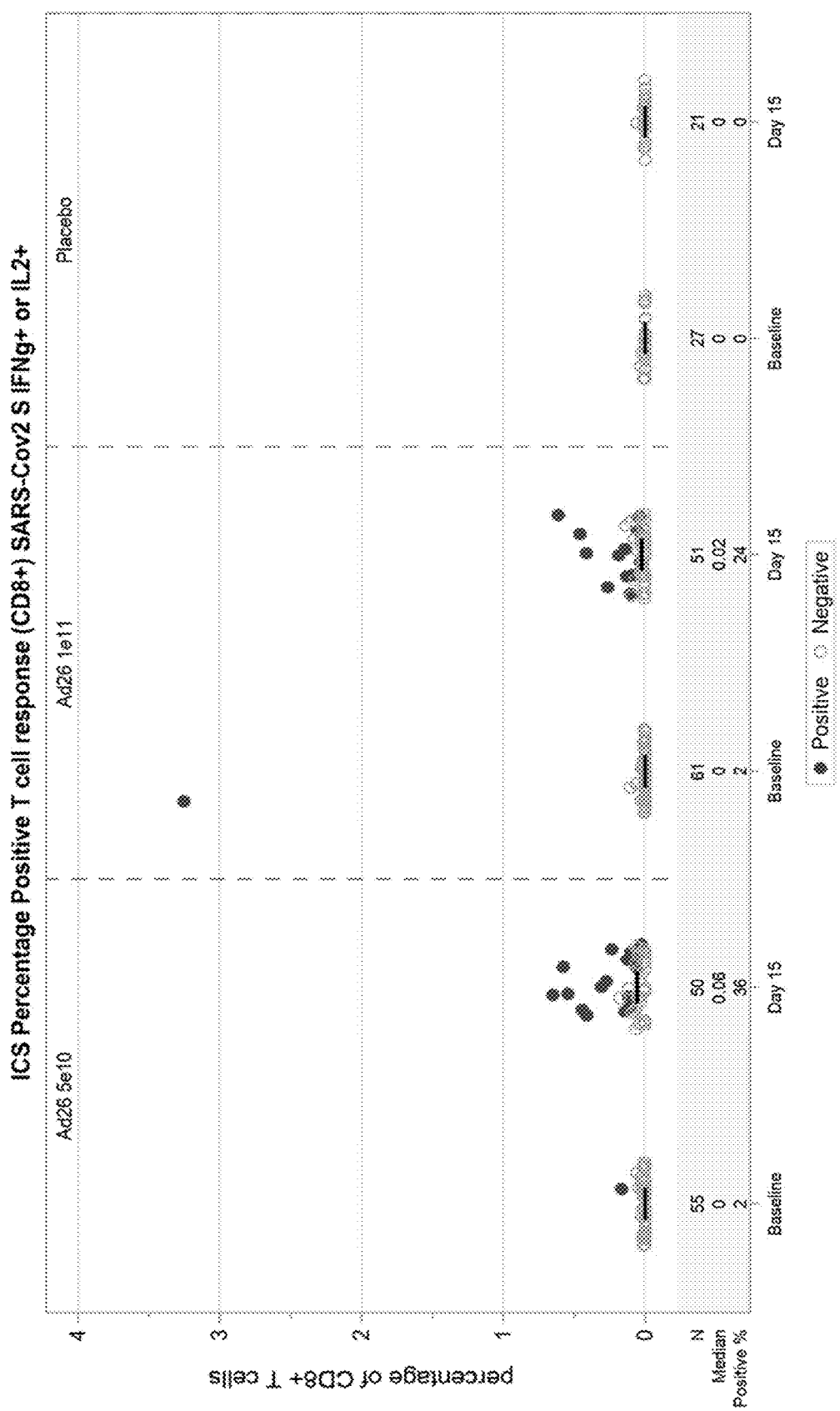

FIG. 115: shows the descriptive statistics for CD8+ T cells producing IFNγ and/or IL-2 in response to SARS-CoV-2 S peptide stimulation.

Figure 116:
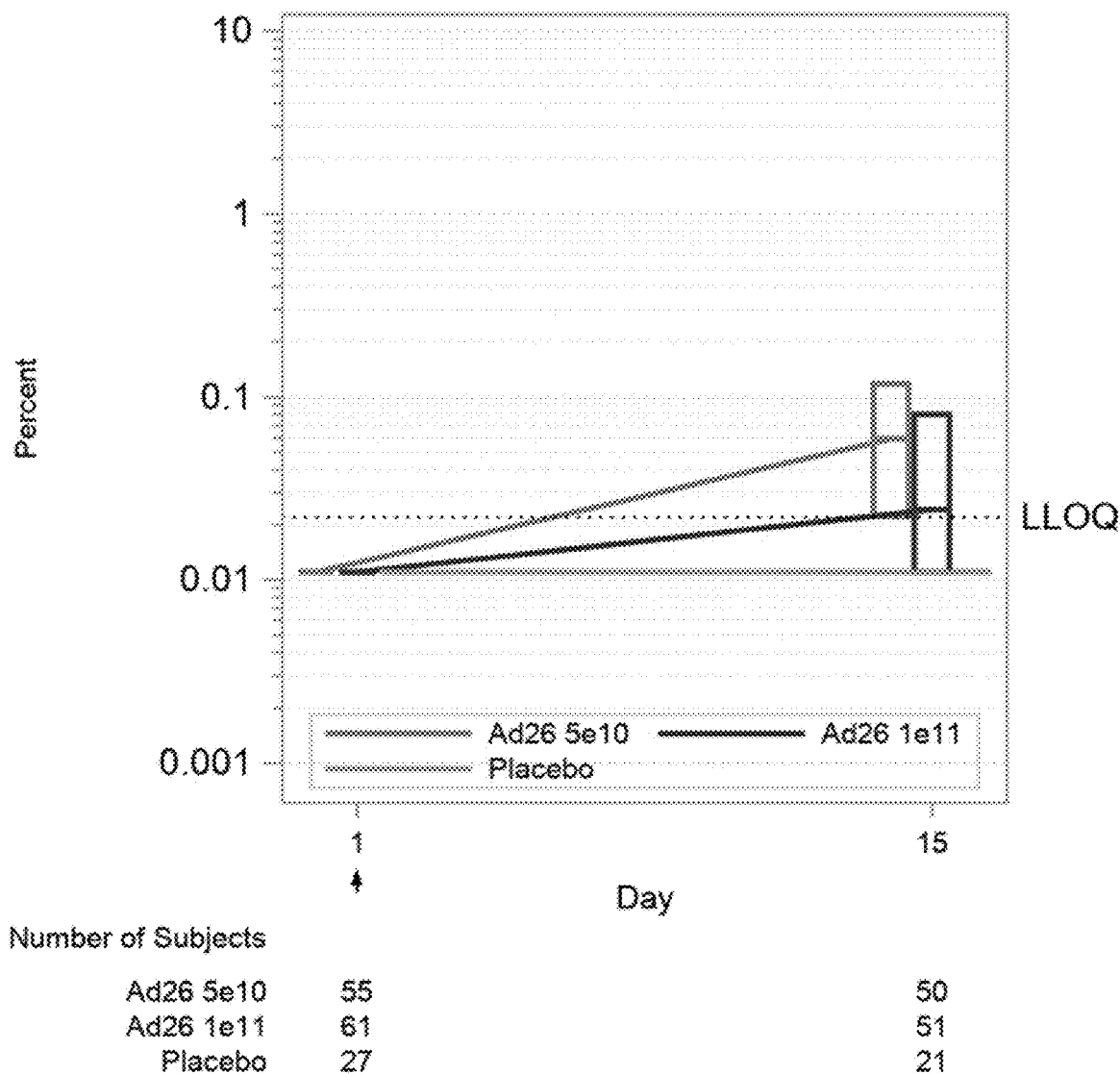

FIG. 116: shows the combined regimen profile.

Figure 117A:
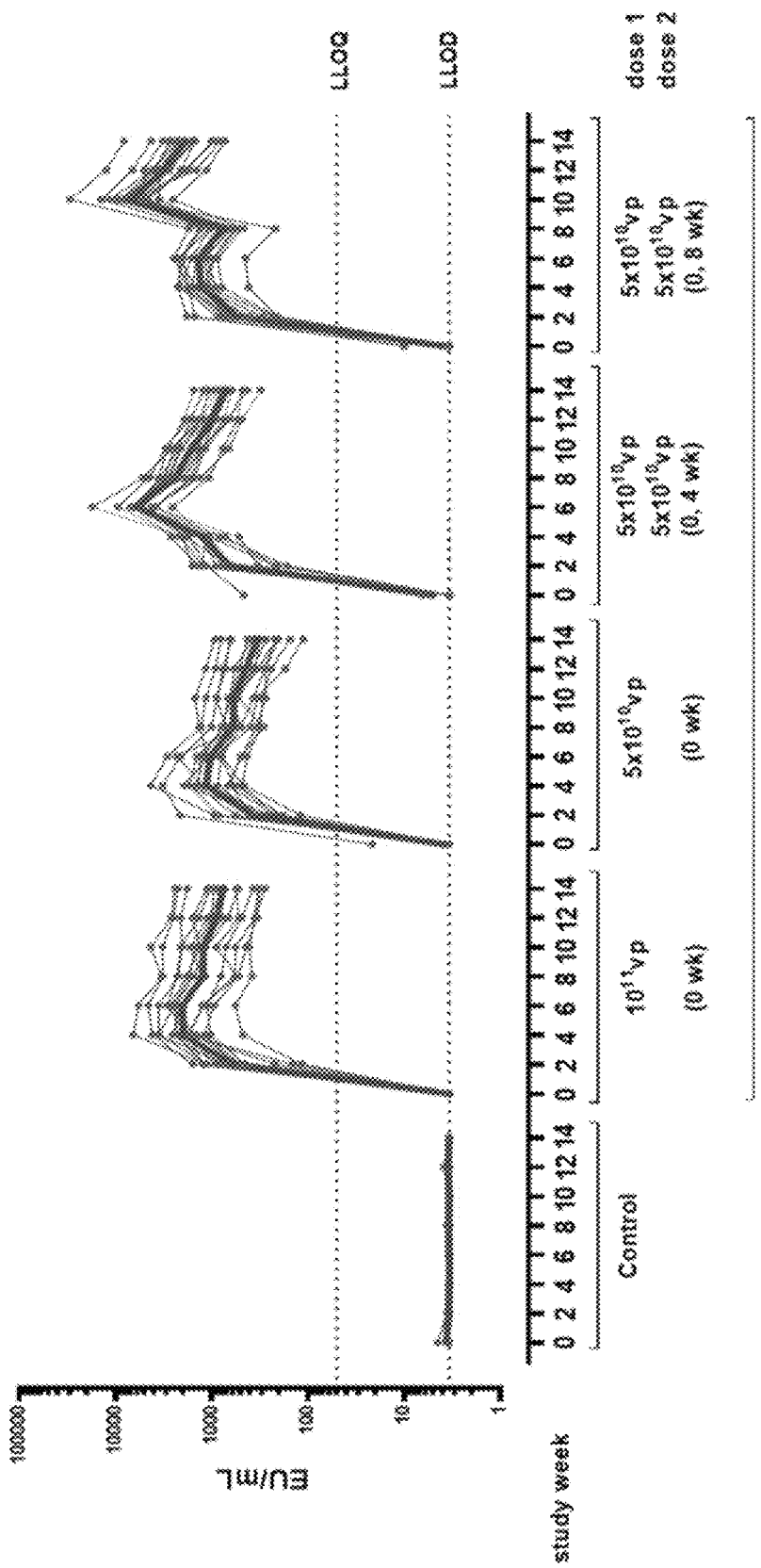
Figure 117B:
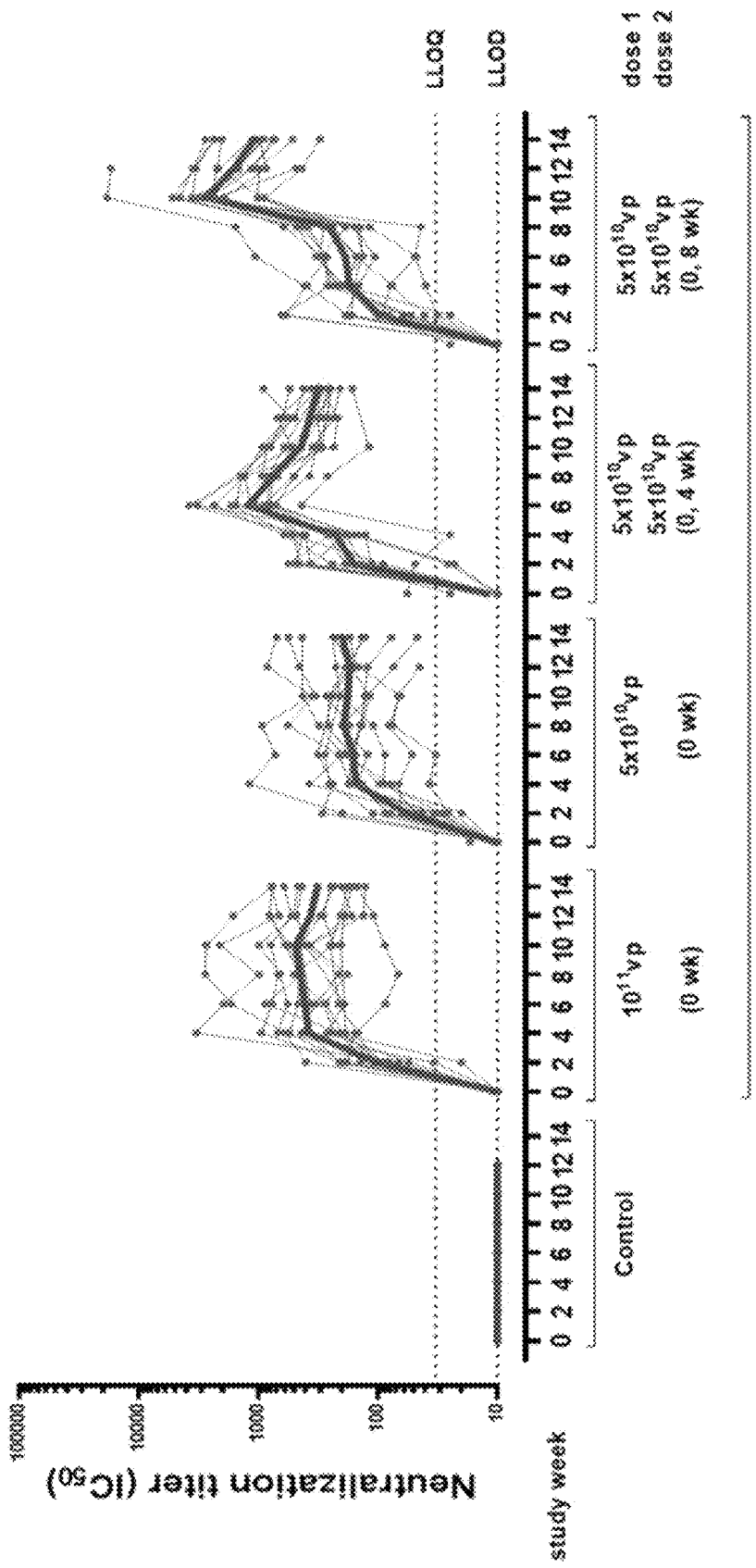
Figure 117C:
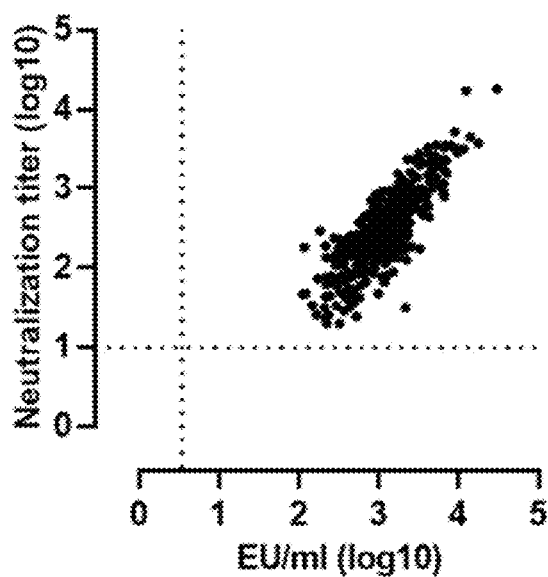

FIG. 117A-117C: SARS-CoV-2-specific humoral immune responses to 1- and 2-dose Ad26.COV2.S vaccine regimes in adult rhesus macaques. (FIG. 117A) Spike (S) protein binding antibody levels were measured over time with a qualified ELISA for human samples, using a trimeric, soluble stabilized S protein produced in mammalian cells as coating antigen. Individual animal levels are depicted with grey points and paired measurements connected with grey lines. The geometric mean titers (GMT) of binding antibody responses per group is indicated with the red line. The dotted lines indicate the lower limit of detection (LLOD) and lower limit of quantification (LLOQ). (FIG. 117B) S protein neutralizing antibody levels were measured over time with a qualified psVNA for human samples, using pseudotyped virus particles made from a modified Vesicular Stomatitis Virus (VSVΔG) backbone and bear the S glycoprotein of SARS-CoV-2. Neutralizing antibody responses are measured as the reciprocal of the sample dilution where 50% neutralization is achieved ($IC_{50}$). Individual animal levels are depicted with grey points and paired measurements connected with grey lines. The GMT of neutralizing antibody responses per group is indicated with the red line. The dotted lines indicate the LLOD and LLOQ. (FIG. 117C) Correlation between S-specific binding antibody levels and neutralizing antibody titers per animal for all groups and timepoints except the sham control group and week 0 (baseline). The dotted lines indicate the LLOD for each assay.

Figure 118A:
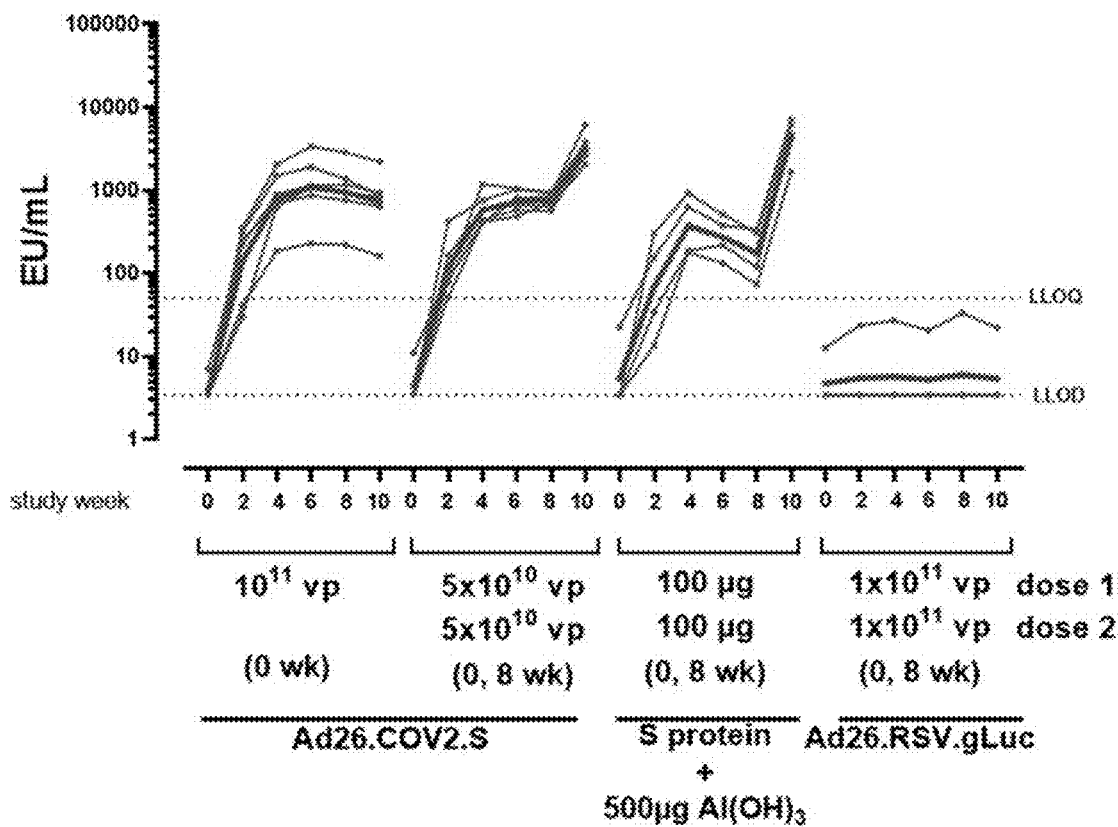
Figure 118B:
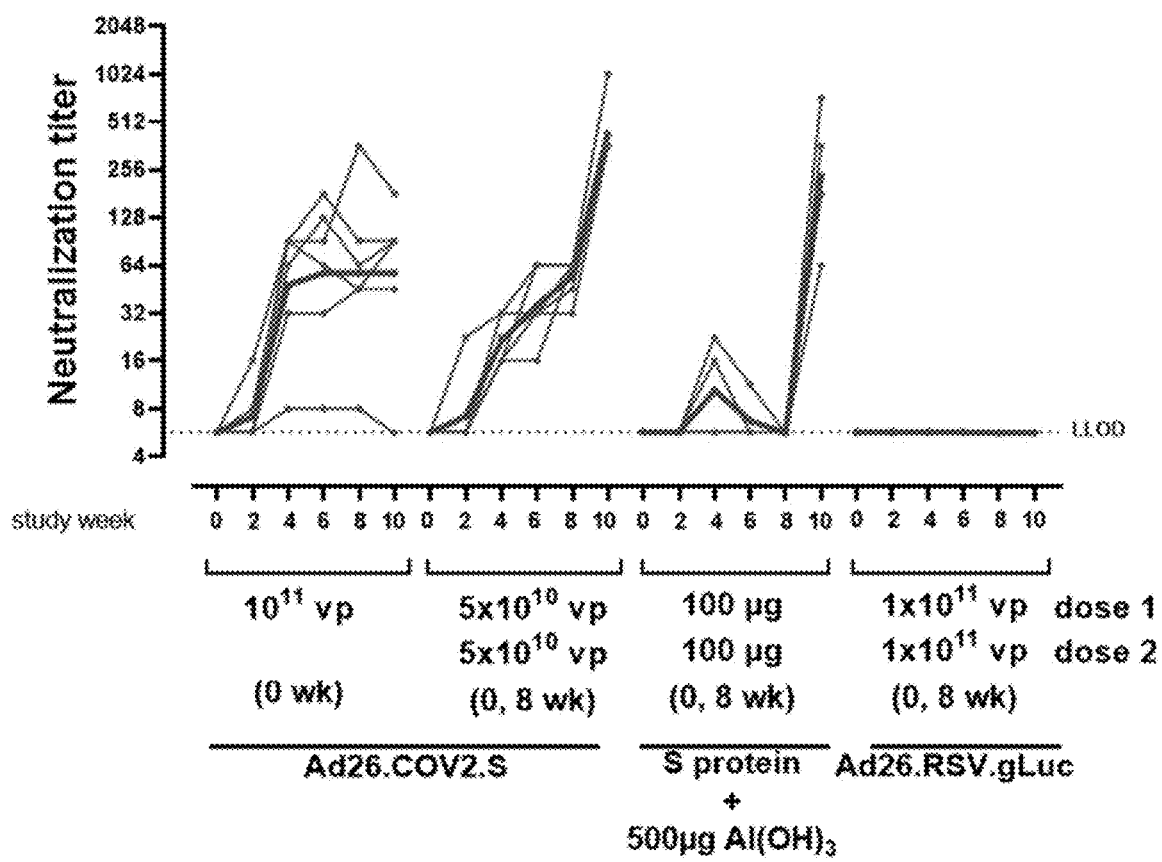
Figure 118C:
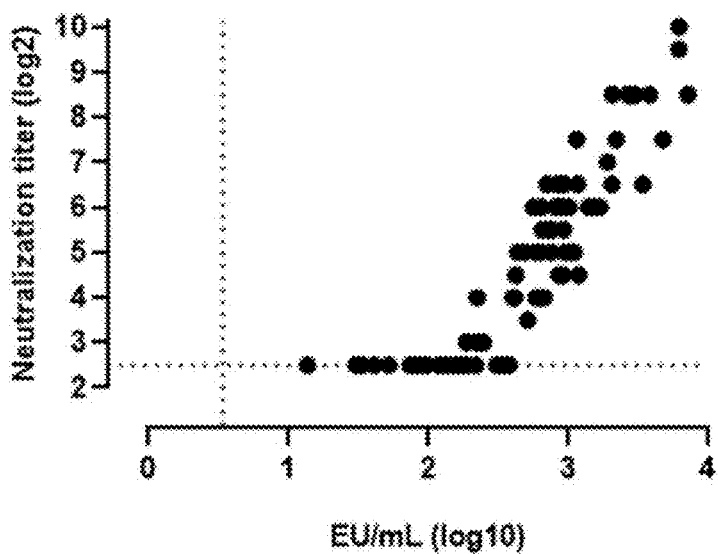

FIG. 118A-118C: SARS-CoV-2-specific humoral and cellular immune responses after vaccination of aged rhesus macaques. (FIG. 118A) Spike (S) protein binding antibody levels were measured over time with a qualified ELISA for human samples, using a trimeric, soluble stabilized S protein produced in mammalian cells as coating antigen. Individual animal levels are depicted with grey points and paired measurements connected with grey lines. The geometric mean titer (GMT) of binding antibody responses per group is indicated with the red line. The dotted lines indicate the lower limit of detection (LLOD) and lower limit of quantification (LLOQ). (FIG. 118B) SARS-Cov-2 neutralization antibody titers over time, as measured by wtVNA. Individual animal levels are depicted with grey points and paired measurements connected with grey lines. The GMT per group is indicated with the red line. The dotted line indicates the LLOD. (FIG. 118C) Correlation between S-specific binding antibody levels and neutralizing antibody titers per animal for all groups and timepoints except the sham control group and week 0. The dotted lines indicate the LLOD for each assay.

Figure 119C:
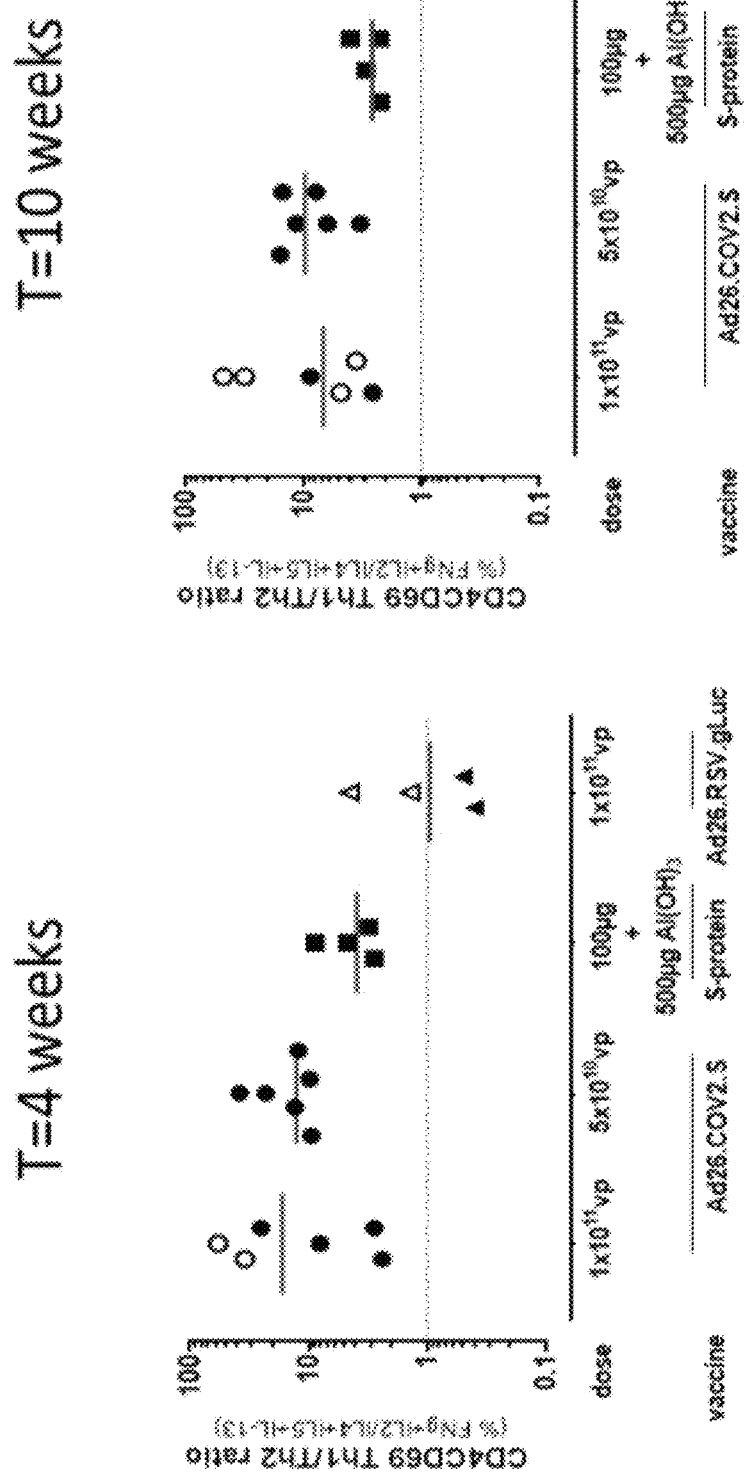

FIG. 119A-119C: SARS-CoV-2-specific cellular immune responses after vaccination of aged rhesus macaques. (FIG. 119A) Spike (S) protein-specific T cell responses as measured with an IFN-γ/IL-4 Double-color ELISpot at indicated timepoints. The geometric mean titer (GMT) response per group is indicated with a horizontal line. Samples with background subtracted counts below or equal to 0 were set a 10 for visualization purposes, indicated by the dotted line. (FIG. 119B) Spike (S) protein-specific T cell responses as measured by intracellular cytokine staining at indicated timepoints. Frequency of CD4+CD69+ T cell expressing cytokines. The geometric mean titer (GMT) response per group is indicated with a horizontal line. The dotted line indicates the technical threshold. Open symbols denote samples at technical threshold. (FIG. 119C) ratio of CD4+CD69+ T cells expressing Th1 (IFN-γ or IL-2) or Th2 (IL-4, IL-5, IL-13) cytokines. The geometric mean titer (GMT) response per group is indicated with a horizontal line. Open symbols denote values were either cells expressing Th1, Th2 or any cytokine were at the technical threshold. The dotted horizontal line is set at a ratio of 1 for visualization purposes.

FIG. 120: Spike (S) protein-specific T cell responses as measured by intracellular cytokine staining at indicated timepoints. Frequency of CD8+CD69+ T cell expressing cytokines. The geometric mean titer (GMT) response per group is indicated with a horizontal line. The dotted line indicates the technical threshold. Open symbols denote samples at technical threshold.

Figure 121A:
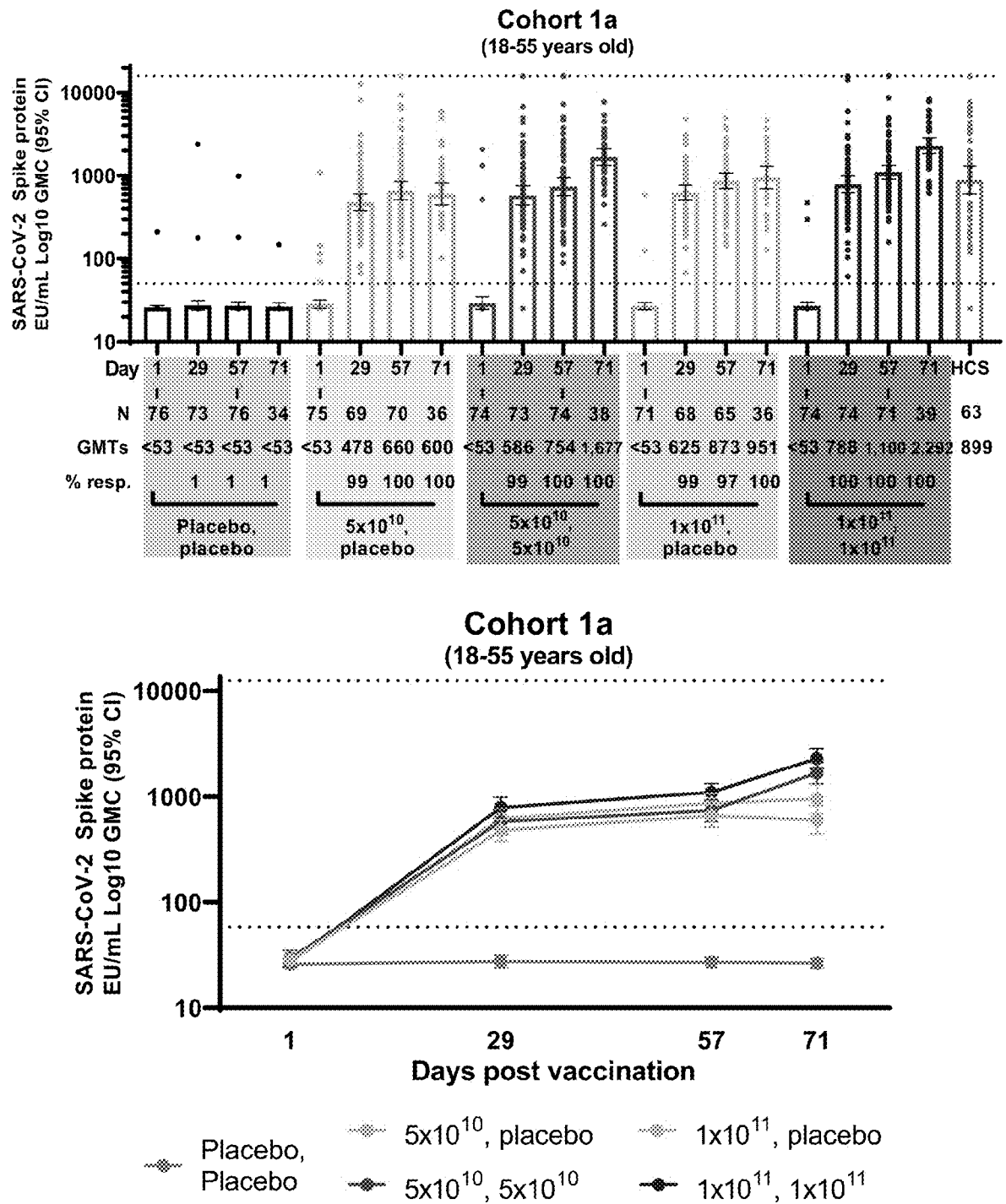
Figure 121B:
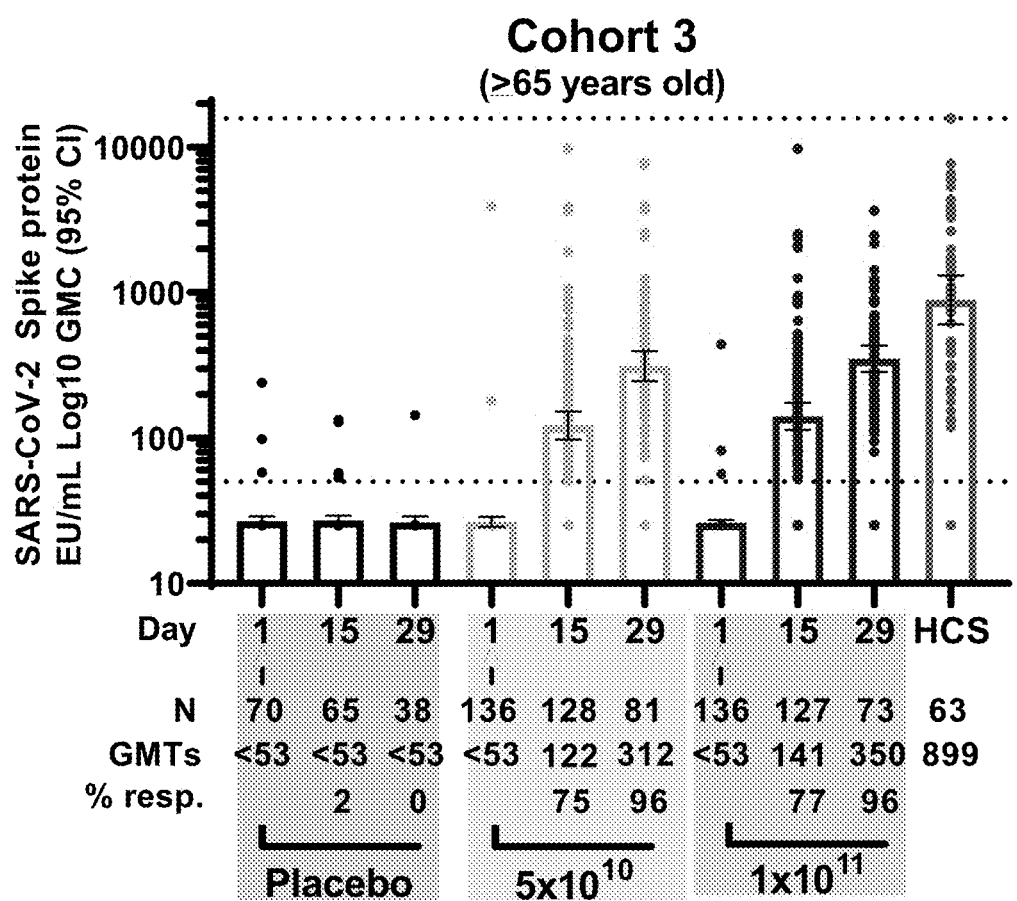

FIGS. 121A-121D: Log geometric mean titers (GMTs—as illustrated by the horizontal bars and the numbers below each timepoint) of SARS-CoV-2 Spike protein binding antibodies in serum as measured by ELISA (ELISA Units per mL [EU/mL]), at baseline and at Day 29 post vaccination, among all participants, and Day 57 and Day 71 for those available for cohort 1a, according to schedule in cohort 1a (18-55 years old) (FIG. 121A) and cohort 3 (>65 years old) (FIG. 121B). Dotted lines indicate the lower limit of quantification (LLOQ) and upper limit of quantification (ULOQ) of the assay, error bars indicate 95% confidence interval (CI). For values below the LLOQ, LLOQ/2 values were plotted.

Figure 121C:
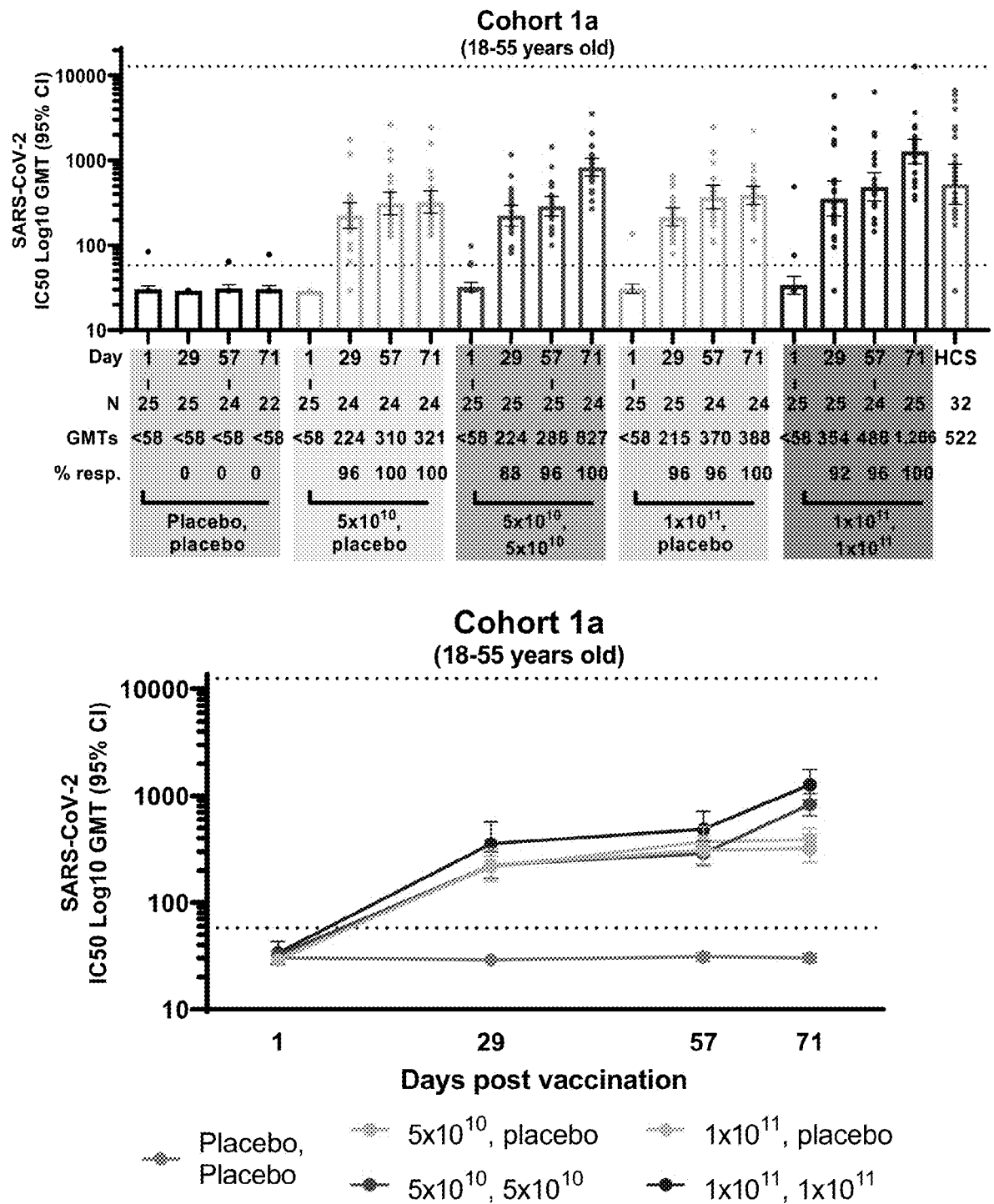
Figure 121D:
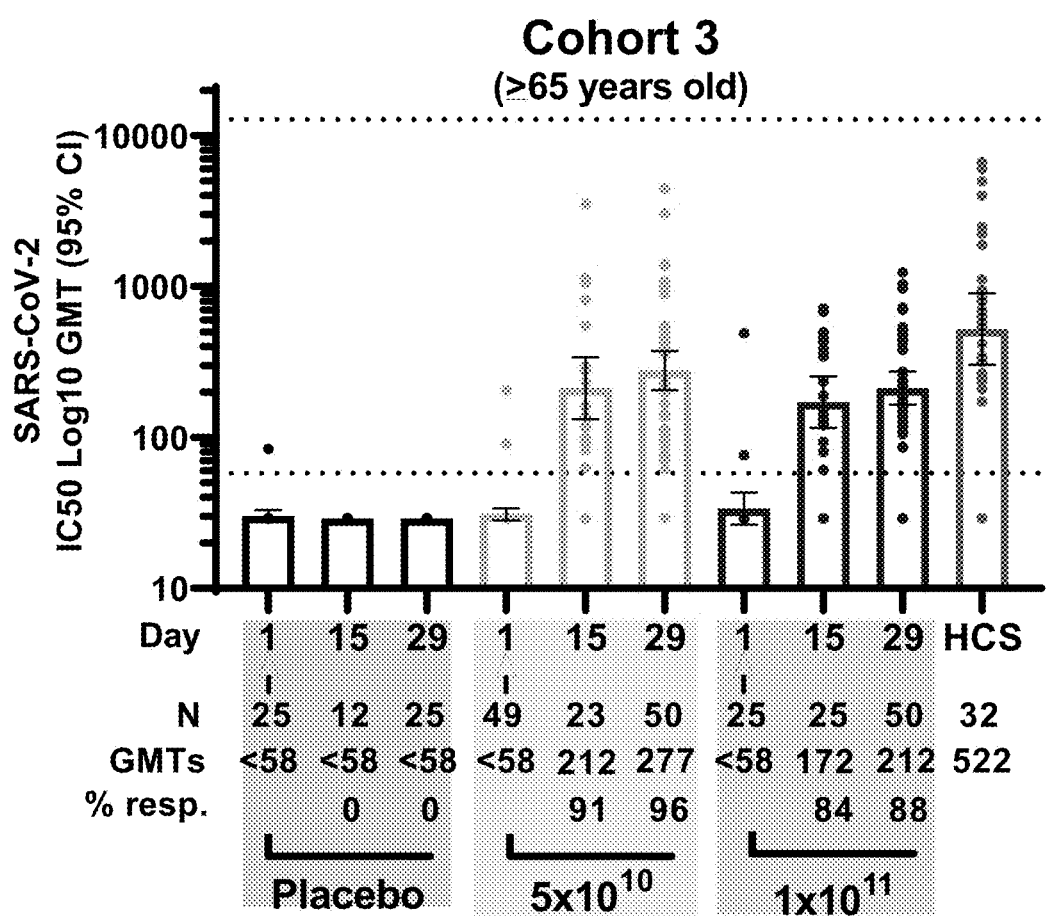

Log GMTs of serum SARS-CoV-2 neutralizing antibodies (wtVNA), measured by 50% neutralization assay (IC50 Log GMT—as illustrated by the horizontal bars and the numbers below each timepoint), at baseline and at Day 29, Day 57 and Day 71 post vaccination, among a subset of participants, according to schedule, cohort 1a (18-55 years old) (FIG. 121C) and cohort 3 (>65 years old) (FIG. 121D). Dotted lines indicate the LLOQ and ULOQ of the assay run with the current pre-dilution used for vaccine samples, error bars indicate 95% CI. For values below the LLOQ, LLOQ/2 values were plotted.

FIGS. 122A-122F: Log GMTs of serum SARS-CoV-2 neutralizing antibodies (wtVNA), measured by 80% neutralization assay.

(IC80 Log GMT—as illustrated by the black dots and the numbers below each timepoint), at baseline and at Day 29, 57 and 71 post vaccination, among a subset of participants, according to schedule, cohort 1a (18-55 years old) and at day 1, 15 and 29 post vaccination cohort 3 (>65 years old).

Figure 123:
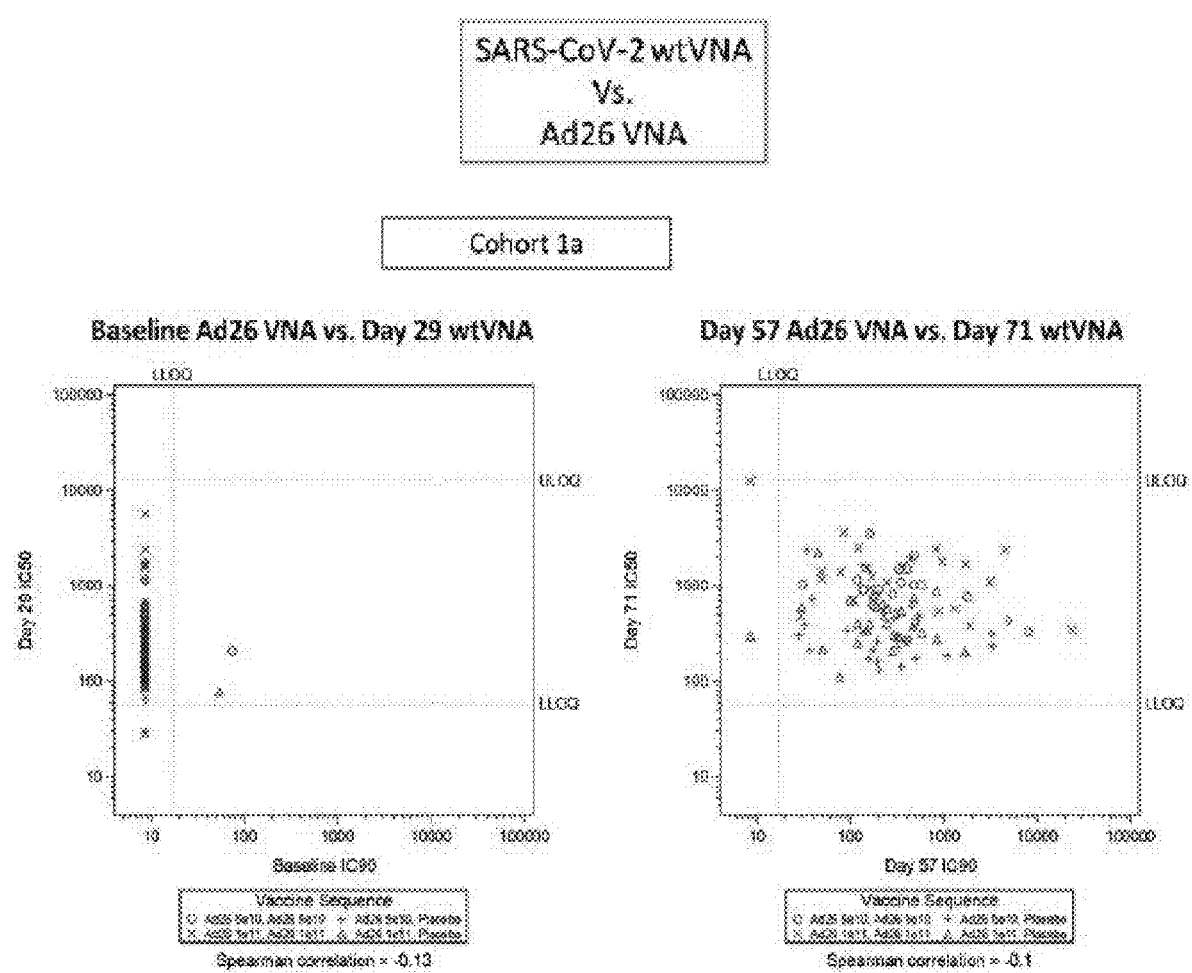

FIG. 123: Correlation plot between Ad26 and SARS-CoV-2 neutralizing antibody titers: baseline Ad26 VNA baseline vs. wtVNA day 29, and Ad26 VNA at day 57 vs. wtVNA at day 71

Figure 124A:
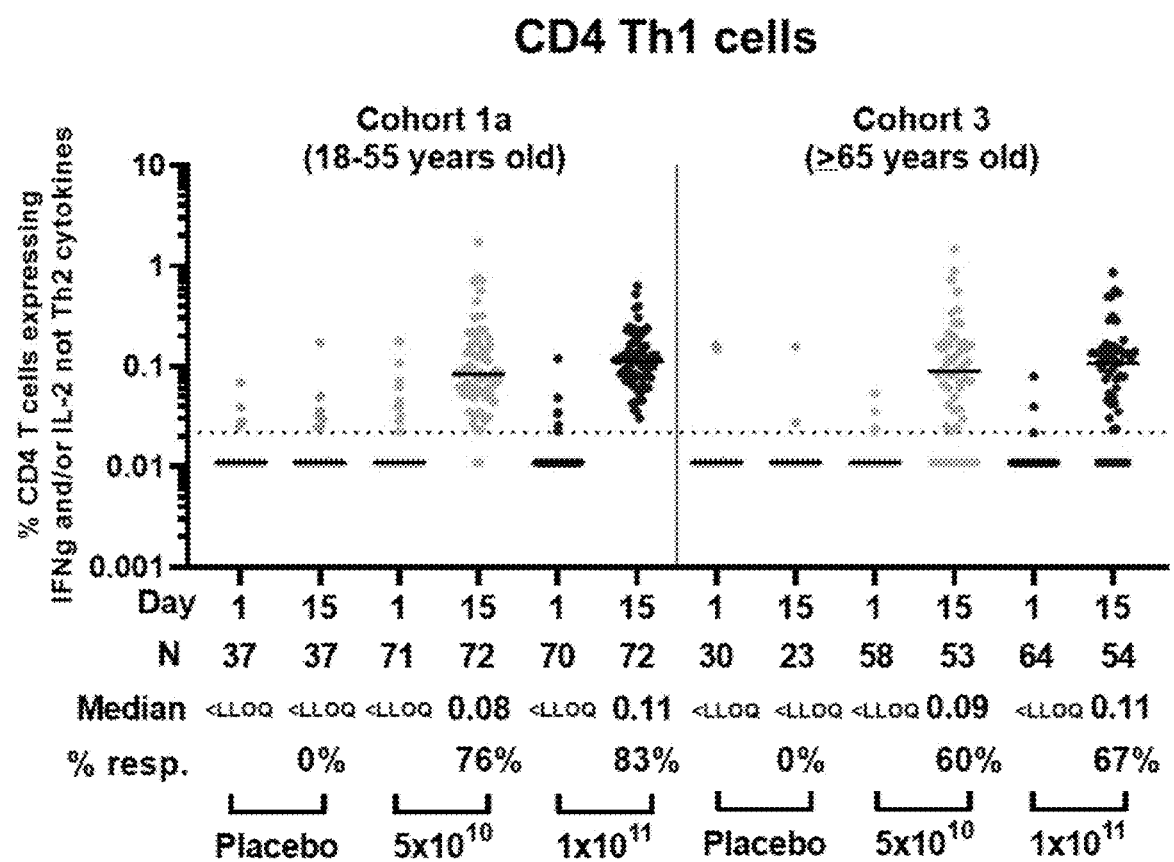
Figure 124B:
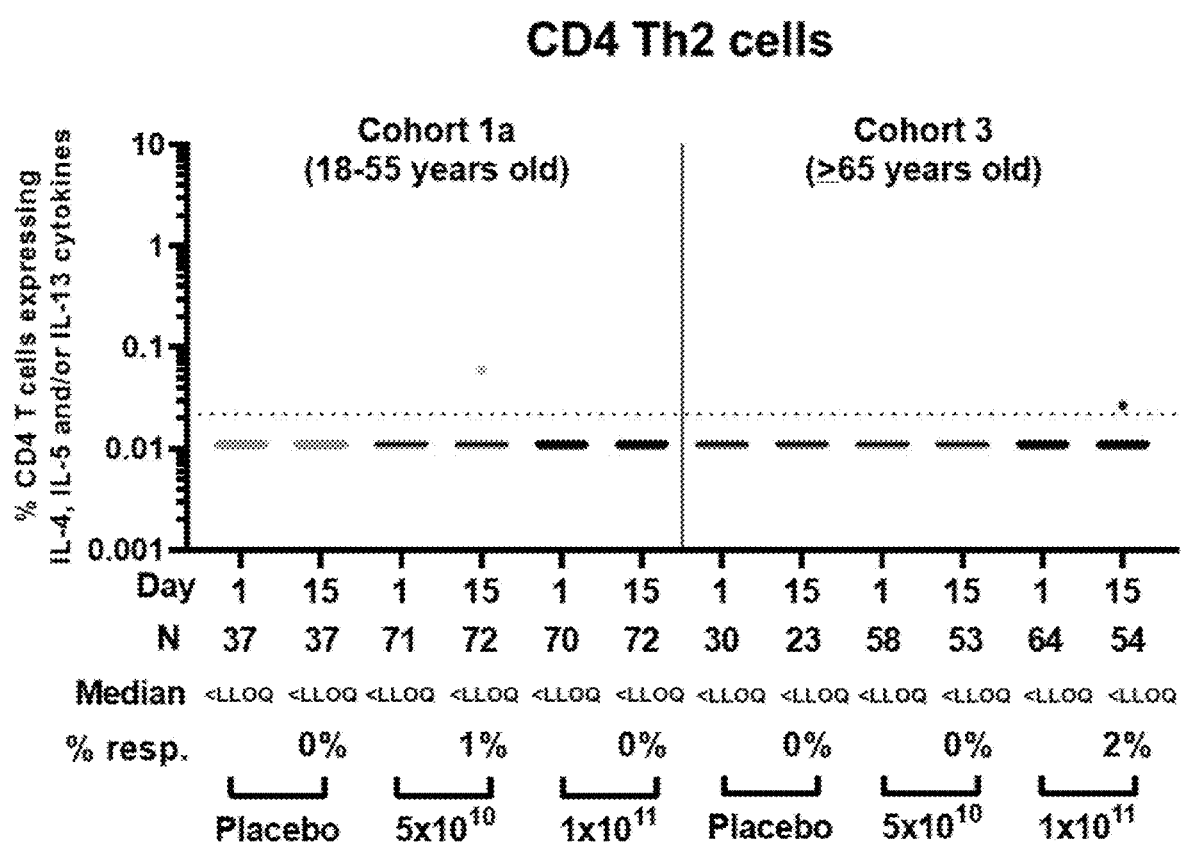
Figure 124C:
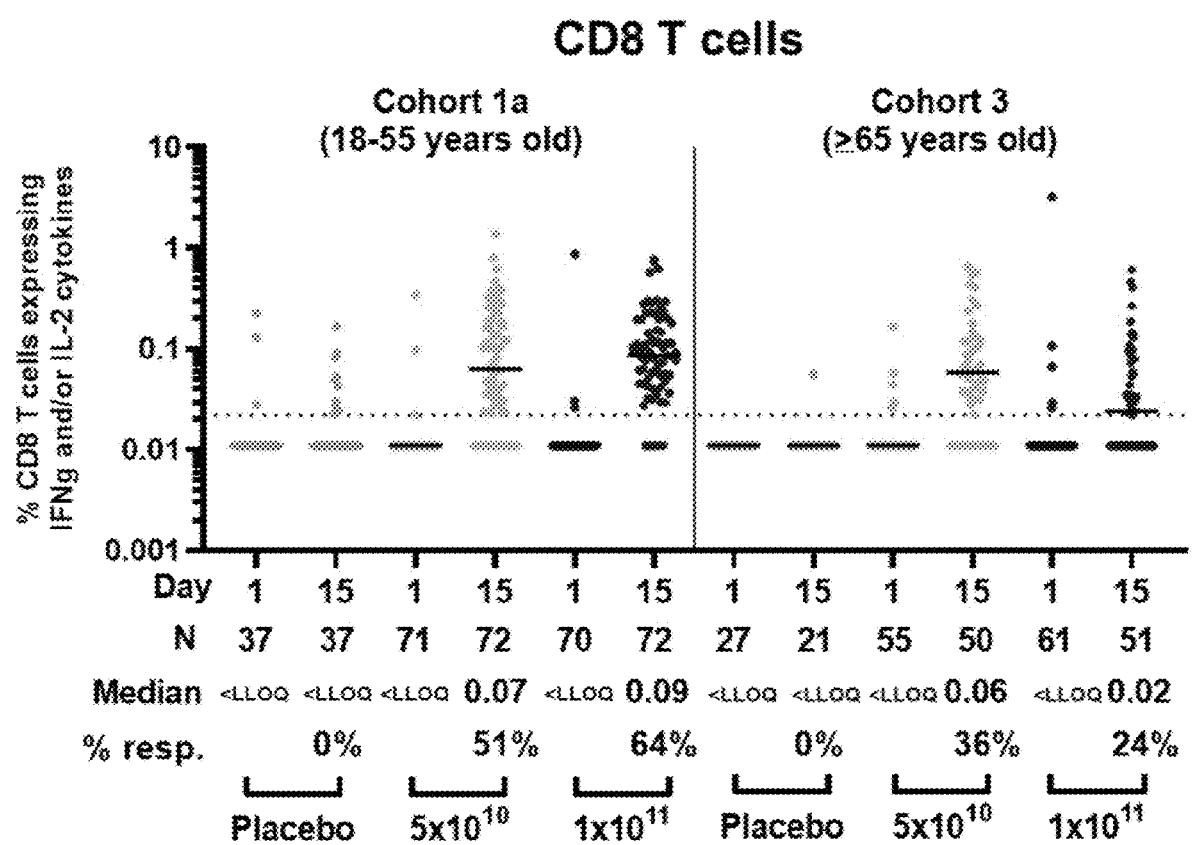

FIGS. 124A-124C: Expression of Th1 (IFN-γ and/or IL-2, and not IL-4, IL-5 and IL-13) (FIG. 124A), and Th2 (IL-4 and/or IL-5 and/or IL-13 and CD40L) (FIG. 124B) cytokines by CD4+ T cells was measured by intracellular cytokine staining (ICS). Median (as illustrated by the horizontal bars and the numbers below each timepoint) and individual ICS responses to a SARS-CoV-2 S protein peptide pool in peripheral blood mononuclear cells, at baseline and 15 days post vaccination, among a subset of participants from cohort 1a (18-55 years old) and cohort 3 (>65 years old), according to schedule, are given. The Y-axis denotes the percentage of T cells positive for the Th1 or Th2 cytokines. Dotted line indicates the LLOQ. Values below the LLOQ were plotted as LLOQ/2.

(FIG. 124C) Expression of IFN-γ and/or IL-2 cytokines by CD8+ T cells was measured by ICS. Median (as illustrated by the horizontal bars and the numbers below each timepoint) and individual ICS responses to SARS-CoV-2 S protein peptide pool in peripheral blood mononuclear cells, at baseline and 15 days post vaccination, among a subset of participants from cohort 1a (18-55 years old) and cohort 3 (>65 years old), according to schedule, are given. The Y-axis denotes the percentage of CD8+ T cells positive for IFN-γ and/or IL-2 cytokines. Dotted line indicates the LLOQ. Values below the LLOQ were plotted as LLOQ/2.

Figure 125A:
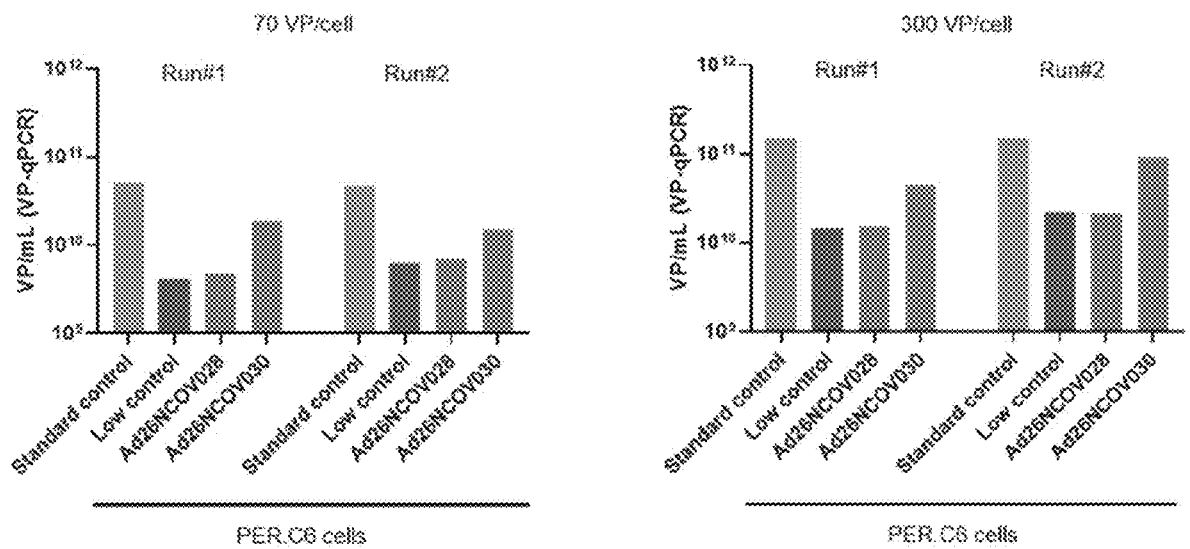
Figure 125B:
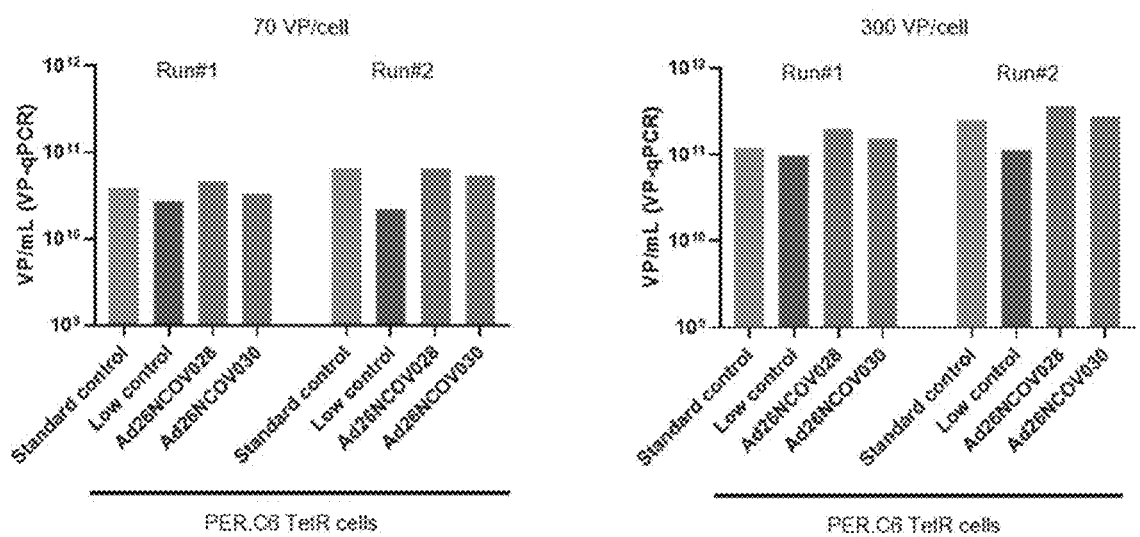

FIGS. 125A-125B: Relative productivity of Ad26NCOV030 (JNJ 78436735) and Ad26NCOV028 purified material in sPER.C6 and PER.C6 TetR cells. A). sPER.C6 cells B) sPER.C6 TetR cells. Cells were transduced in shaker flasks with purified material of the Ad26 vector (70 or 300 VP/cell). Samples were taken at 0, 1, 2, 3, and 4 days post infection, and vector particle concentration was measured by VP-qPCR. Standard control (Ad26.ZEBOV) and low control (26ZIK001). VP, viral particles; qPCR, quantitative polymerase chain reaction; TetR, tetracycline repressor.

FIGS. 126A-126E: Titration of SARS-CoV-2 challenge dose and characterization of histopathology in Syrian hamsters. Syrian hamsters (N=12 per group), were inoculated intra-nasally with $10^2$, $10^{3.3}$, $10^{4.6}$ or $10^{5.9}$ TCID$_{50}$ SARS-CoV-2 BetaCoV/Munich/BavPat1/2020, or mock-inoculated with Vero E6 cell-supernatant. Daily throat swabs were taken, and 2, 3, 4, and 7 days p.i., 3 hamsters per group were sacrificed and nose and lung tissue collected for virological analysis and histopathology. Replication competent viral load in (FIG. 126A) lung tissue, (FIG. 126B) nose tissue, and (FIG. 126C) throat swabs, was determined by TCID$_{50}$ assay on Vero E6 cells. LLOD was calculated per animal per gram or milliliter of tissue, and animals with a response at or below the LLOD are shown as open symbols. (FIG. 126D) Lung tissue was analyzed and scored for presence and severity of alveolitis, alveolar damage, alveolar edema, alveolar hemorrhage, type II pneumocyte hyperplasia, bronchitis, bronchiolitis, peribronchial and perivascular cuffing. Sum of scores are presented as sum of LRT disease parameters (potential range: 0-24). (FIG. 126E) Nose tissue was analyzed and scored for severity of rhinitis on a scale from 0 to 3. Dotted lines indicate the minimal and maximal scores of histopathology. Median responses per group are indicated with horizontal lines, error bars in panel c indicate the range. p.i.=post inoculation; LLOD=lower limit of detection; LRT=lower respiratory tract; N=number of animals; TCID50/g=50% tissue culture infective dose per gram tissue; TCID50/ml=50% tissue culture infective dose per milliliter sample; vp=virus particles.

Figure 127A:
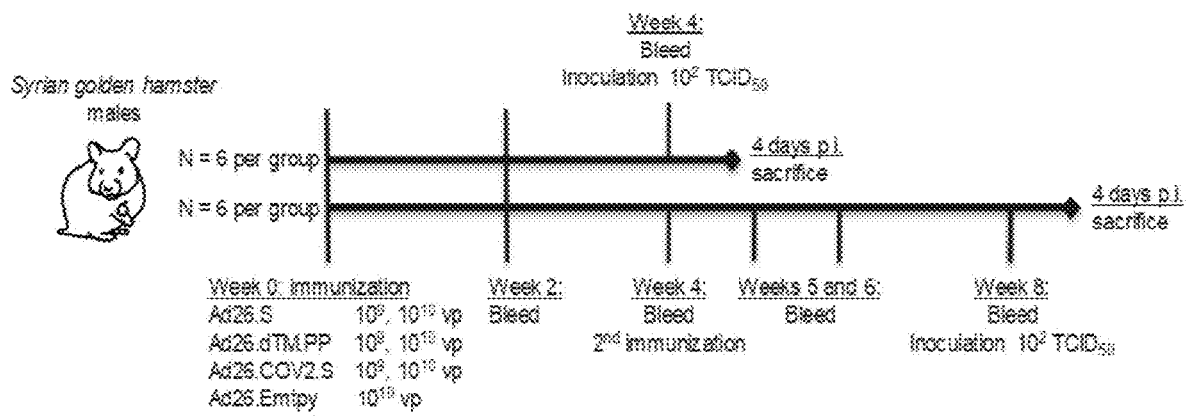
Figure 127B:
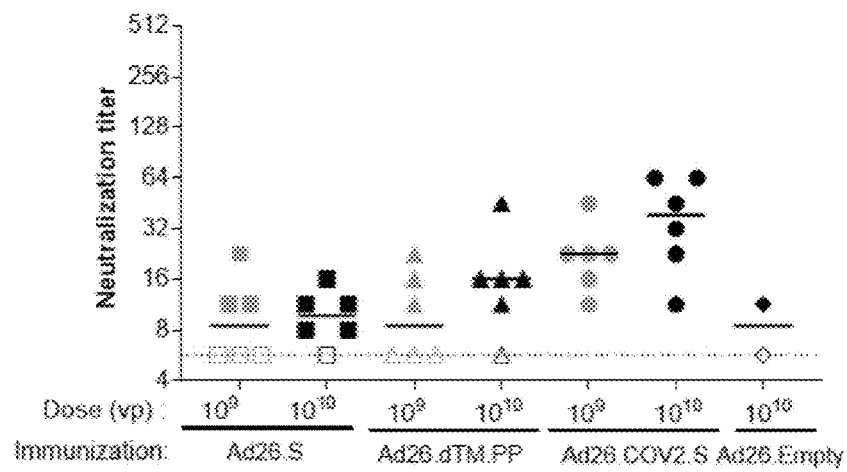
Figure 127C:
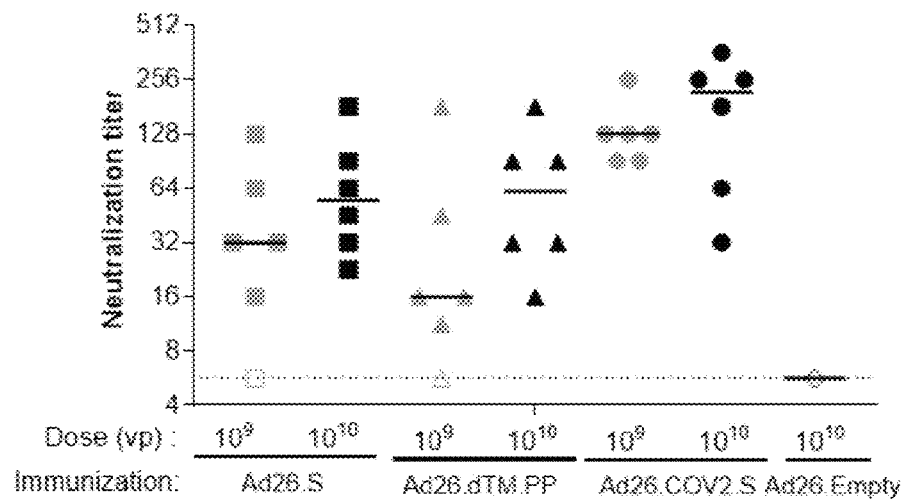

FIGS. 127A-127C: SARS-CoV-2 neutralizing antibody response elicited by 1- and 2-dose Ad26.COV2.S vaccine regimes in Syrian hamsters. (FIG. 127A) Syrian hamsters were immunized with either $10^9$ or $10^{10}$ VP (N=12 per dose level) of Ad26-based vaccines candidates, or with $10^{10}$ vp of an Ad26 vector without gene insert as control (Ad26.empty, N=6). Four weeks after immunization half the hamsters per group received a second immunization with the same Ad26-based vaccine candidate (N=6 per group). (FIG. 127B) SARS-CoV-2 neutralization titers were measured 4 weeks after dose 1 and (FIG. 127C) 4 weeks after dose 2 by wild-type VNA determining the inhibition of the cytopathic effect of SARS-CoV-2 on Vero E6 cells. The sera from Syrian hamsters immunized with Ad26.Empty were pooled into 2 groups for negative control samples. Median responses per group are indicated with horizontal lines. Dotted lines indicate the LLOD. Animals with a response at or below the LLOD are displayed as open symbols on the LLOD. CPE=cytopathic effect; LLOD=Lower Limit of Detection; p.i.=post inoculation; VNA=virus neutralization assay; VP=virus particles.

Figure 128A:
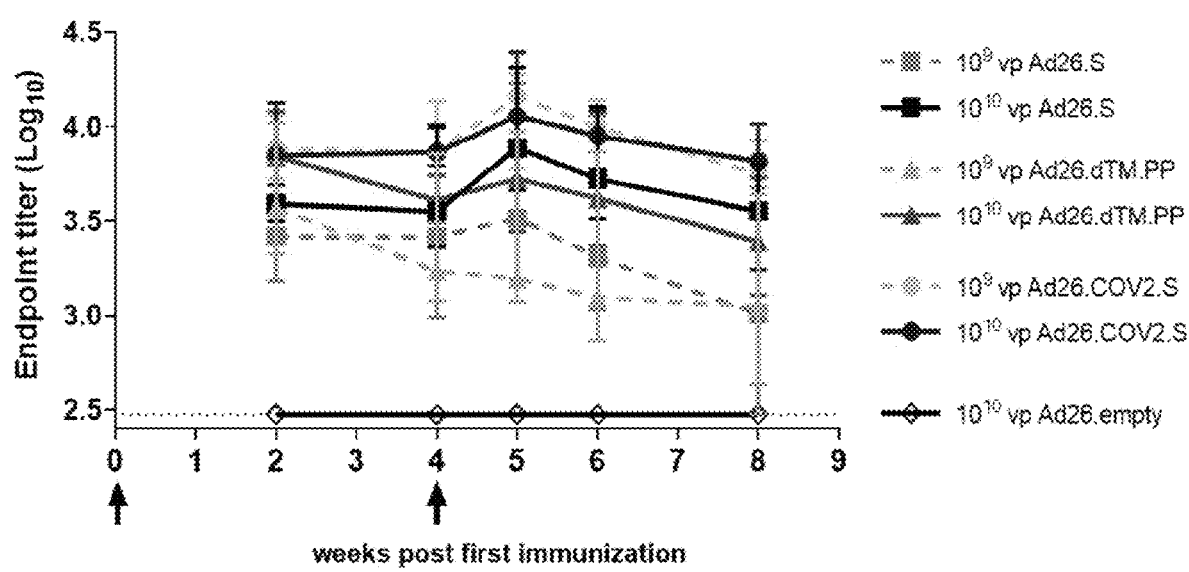
Figure 128B:
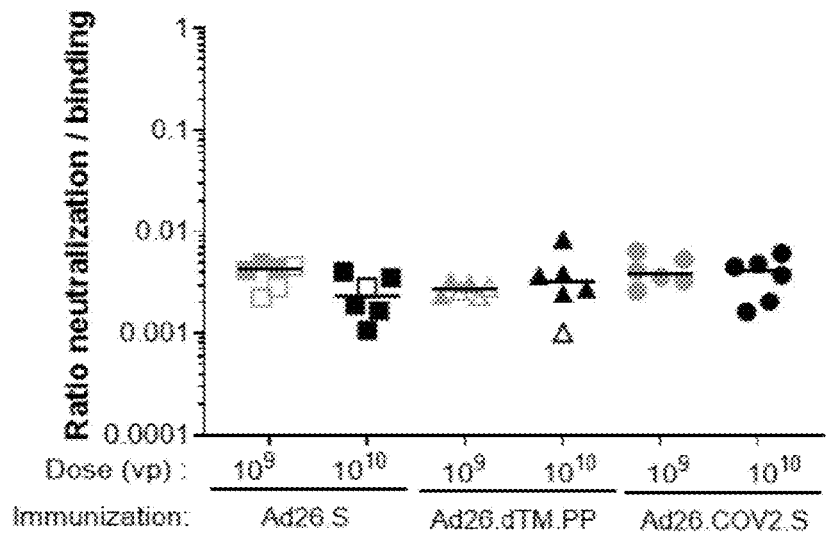
Figure 128C:
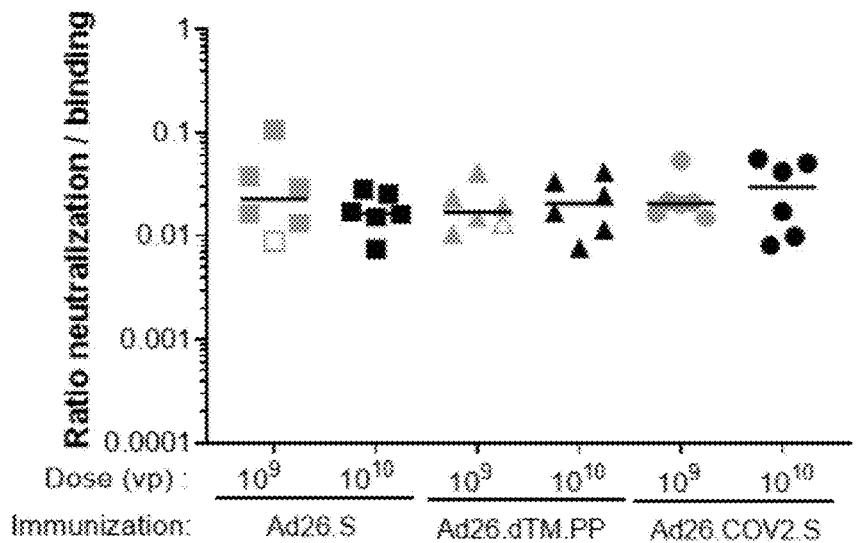
Figure 129A:
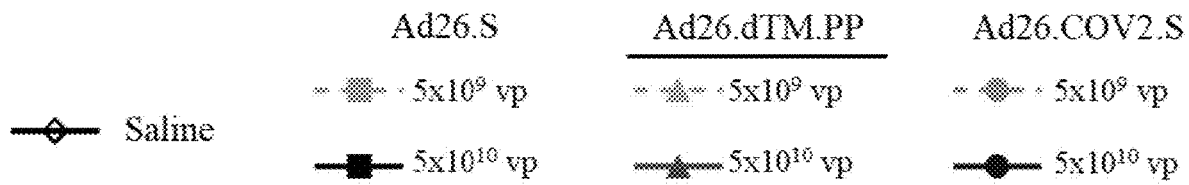
Figure 129B:
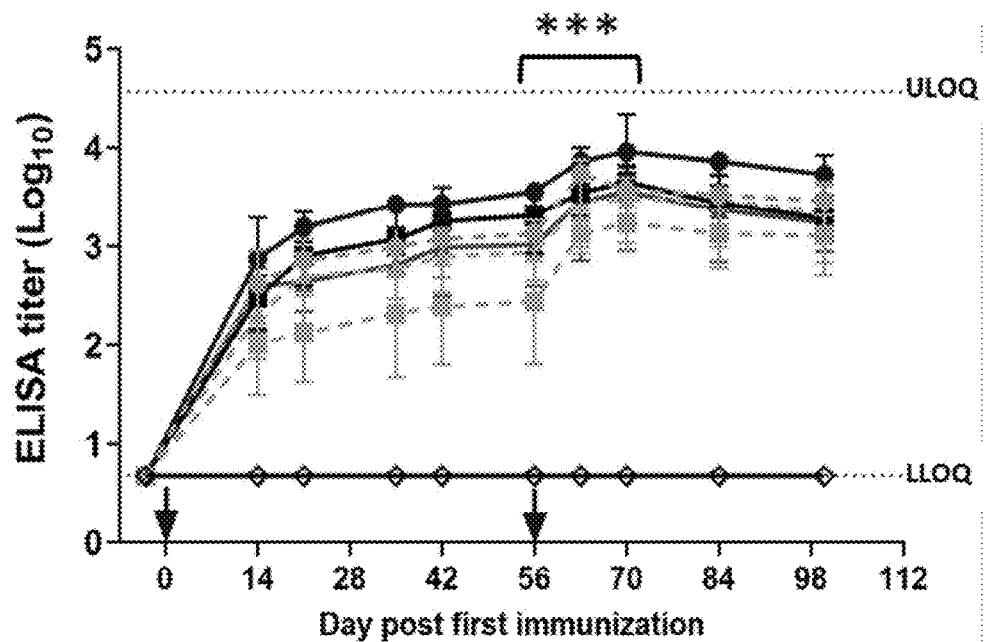
Figure 129C:
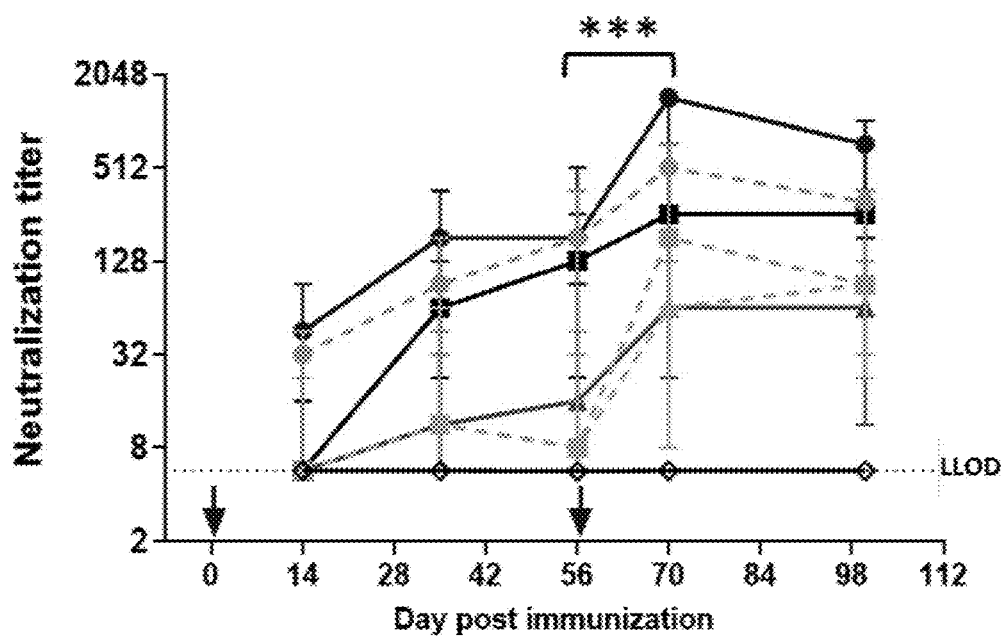

FIGS. 128A-128C: SARS-CoV-2 spike protein binding antibody response, and ratio with neutralizing antibody responses, elicited by 1- and 2-dose Ad26 vaccine regimes in Syrian hamsters. Syrian hamsters were immunized with either $10^9$ or $10^{10}$ VP of Ad26-based vaccine candidates Ad26.S, Ad26.dTM.PP or Ad26.COV2.S, or with $10^{10}$ vp of an Ad26 vector without gene insert as control (Ad26.empty). Four weeks after immunization half the hamsters per group received a second immunization with the same Ad26-based vaccine candidate (N=6 per group). Two and 4 weeks after one immunization, and 1, 2 and 4 weeks after the second immunization (weeks 5, 6 and 8 respectively), blood samples were collected and serum isolated for serological analyses. (FIG. 128A) SARS-CoV-2 spike protein-specific antibody binding titers of hamsters receiving two immunizations (N=6 per group) were measured by ELISA. (FIG. 128B) Neutralization titers were measured 4 weeks after dose 1 (hamsters receiving one immunizations, N=6 per group) and (FIG. 128C) 4 weeks after dose 2 (hamsters receiving two immunizations, N=6 per group). The ratio of SARS-CoV-2 neutralizing antibodies over binding antibodies was calculated by dividing antibody titers as measured by wtVNA, by antibody titers as measured by ELISA. Animals with neutralization titers at or below the LLOD are displayed as open symbols. Median responses per group are indicated with horizontal lines. LLOD=Lower Limit of Detection; ELISA=Enzyme-linked Immunosorbent assay; wtVNA=wild-type virus neutralization assay; VP=virus particles FIGS. 129A-129C: SARS-CoV-2 spike protein binding antibody response and neutralizing antibody response elicited by a 2-dose Ad26 vaccine regime in New Zealand White rabbits. New Zealand white rabbits were intramuscularly immunized with a 2-dose regimen of $5\times10^9$ vp or $5\times10^{10}$ vp Ad26.S, Ad26.dTM.PP, Ad26.COV2.S, or saline (FIG. 129A). Serum was sampled prior to immunization (day −3) and days 14, 21, 35, 42, 56, 63, 70, 84 and at sacrifice (days 99-101, depicted in the graph as day 100). (FIG. 129B) SARS-CoV-2 spike protein-specific antibody binding titers were measured by ELISA. (FIG. 129C) Neutralization titers were measured on days 14, 35, 56, 70 and at sacrifice. Median responses per group are indicated with horizontal lines, vertical lines denote group ranges. ELISA=Enzyme-linked Immunosorbent assay; wtVNA=wild-type virus neutralization assay; LLOQ=Lower Limit of Qualification; ULOQ=Upper Limit of Qualification; LLOD=Lower Limit of Detection; VP=virus particles.

FIGS. 130A-130F: Protection against SARS-CoV-2 viral replication in Syrian hamsters immunized with Ad26-based vaccine candidates. Syrian hamsters were intramuscularly immunized with a 1-dose regimen and a 2-dose regimen of Ad26.S, Ad26.dTM.PP, Ad26.COV2.S, or Ad26.empty (Ad26 vector not encoding any SARS-CoV-2 antigens). Hamsters received an intranasal inoculation with $10^2$ TCID$_{50}$ SARS-CoV-2 strain BetaCoV/Munich/BavPat1/2020 4 weeks post-dose 1 (week 4) or 4 weeks post-dose 2 (week 8). (FIGS. 130A, 130B) Right lung tissue and (FIGS. 130C, 130D) right nasal turbinates were harvested at the end of the 4-day inoculation phase for viral load analysis. Replication competent virus was measured by TCID$_{50}$ assay. (FIGS. 130E, 130F) Throat swab samples were taken daily after inoculation, and viral load area under the curve during the four-day follow-up was calculated as TCID$_{50}$/ml×day. The median viral load per group is indicated with a horizontal line. LLOD was calculated per animal and animals with a response at or below the LLOD are shown as open symbols on the LLOD. Comparisons were performed between the Ad26.S, Ad26.dTM.PP and Ad26.COV2.S groups across dose level, with the Ad26.empty group by Mann-Whitney U-test. Statistical differences indicated by asterisks: *: p<0.05; **:p<0.01. LLOD=lower limit of detection; $TCID_{50}/g$=50% tissue culture infective dose per gram tissue; TCID50/ml=50% tissue culture infective dose per ml sample; VP=virus particles.

FIGS. 131A-131D: Protection against SARS-CoV-2 IHC and histopathology in lung tissue of Syrian hamsters immunized with Ad26-based vaccine candidates. Syrian hamsters were intramuscularly immunized with a 1-dose regimen and a 2-dose regimen of Ad26.S, Ad26.dTM.PP, Ad26.COV2.S, or Ad26.empty (Ad26 vector not encoding any SARS-CoV-2 antigens). The hamsters received intranasal inoculation with $10^2$ $TCID_{50}$ SARS-CoV-2 strain BetaCoV/Munich/BavPat1/2020 4 weeks post-dose 1 (week 4), or 4 weeks post-dose 2 (week 8). Left lung tissue was isolated 4 days after inoculation for analysis of immunohistochemical SARS-CoV-NP staining and histopathology. Due to a technical failure, tissues of only 2 out of 8 hamsters immunized with one dose of Ad26.Emtpy could be analyzed. (FIGS. 131A and 131B) Presence of SARS-CoV-2 NP was determined by immunohistochemical staining. (FIGS. 131C and 131D) Lung tissue was scored for presence and severity of alveolitis, alveolar damage, alveolar edema, alveolar hemorrhage, type II pneumocyte hyperplasia, bronchitis, bronchiolitis, peribronchial and perivascular cuffing. Sum of scores are presented as sum of LRT disease parameters. Median scores per group are indicated with horizontal lines. Dotted lines indicate the LLOD. Comparisons were performed between the vaccine groups across dose level, with the Ad26.Empty group by Mann-Whitney U-test, except for panel c. Statistical differences indicated by asterisks: *:$p<0.05$; **:$p<0.01$. LLOD=lower limit of detection; VP=virus particles; NP=Nucleocapsid protein; IHC=Immunohistochemistry; LRT=Lower Respiratory Tract.

FIGS. 132A-132D: Protection against SARS-CoV-2 IHC and histopathology in nasal tissue of Syrian hamsters immunized with Ad26-based vaccine candidates. Syrian hamsters were intramuscularly immunized with a 1-dose regimen and a 2-dose regimen of Ad26.S, Ad26.dTM.PP, Ad26.COV2.S, or Ad26.empty (Ad26 vector not encoding any SARS-CoV-2 antigens). The hamsters received intranasal inoculation with $10^2$ $TCID_5O$ SARS-CoV-2 strain BetaCoV/Munich/BavPat1/2020 4 weeks post-dose 1 (week 4), or 4 weeks post-dose 2 (week 8). Left nasal tissue was isolated 4 days after inoculation for analysis of immunohistochemical SARS-CoV-NP staining and histopathology. Due to a technical failure, tissues of only 5 out of 8 hamsters immunized with one dose of Ad26.Emtpy could be analyzed. (FIGS. 132A and 132B) Presence of SARS-CoV-NP was determined by immunohistochemical staining. (FIGS. 132C and 132D) Nasal tissue was scored for severity of rhinitis. Median scores per group are indicated with horizontal lines. Dotted lines indicate the LLOD. Comparisons were performed between the vaccine groups across dose level, with the Ad26.Empty group by Mann-Whitney U-test. Statistical differences indicated by asterisks: *:$p<0.05$; **:$p<0.01$. LLOD=lower limit of detection; VP=virus particles; NP=Nucleocapsid protein; IHC=Immunohistochemistry.

FIGS. 133A-133D: Dose responsiveness of Ad26.COV2.S on immunogenicity and lung viral load in hamsters. Syrian hamsters were intramuscularly immunized with $10^7$, $10^8$, $10^9$ or $10^{10}$ VP of Ad26.COV2.S N=8 per group, or $10^{10}$ VP Ad26.Irr (an Ad26 vector not encoding any SARS-CoV-2 antigens, N=8). Four weeks after one immunization, SARS-CoV-2 Spike protein-specific antibody binding titers (FIG. 133A) and SARS-CoV-2 neutralizing antibodies (FIG. 133B) were determined. The median antibody responses per group is indicated with a horizontal line. Dotted lines indicate the LLOD. Animals with a response at or below the LLOD were put on LLOD and are shown as open symbols. Hamsters received intranasal inoculation with $10^2$ $TCID_{50}$ SARS-CoV-2 strain BetaCoV/Munich/BavPat1/2020 4 weeks post immunization (week 4). Right lung tissue was isolated 4 days after inoculation for virological analysis and immunohistochemistry. (FIG. 133C) Lung viral load was determined by $TCID_{50}$ assay on Vero E6 cells. The median viral load per group is indicated with a horizontal line. LLOD was calculated per animal, and animals with a response at or below the LLOD are shown as open symbols. (FIG. 133D) presence of SARS-CoV-2 NP was determined by immunohistochemical staining. Comparisons were performed between the Ad26.COV2.S dose level groups, with the Ad26.Irr group by Mann-Whitney U-test. Statistical differences indicated by asterisks: *:$p<0.05$; :$p<0.01$; *:$p<0.001$. Ad26.Irr=Ad26 vector not encoding any SARS-CoV-2 antigens; LLOD=lower limit of detection; N=number of animals; $TCID_{50}/g$=50% tissue culture infective dose per gram tissue; VP=virus particles; NP=Nucleocapsid protein.

FIG. 134: No signs of VAERD in Ad26 immunized Syrian hamsters inoculated with SARS-CoV-2 Four days after IN inoculation with $10^2$ $TCID_{50}$ SARS-CoV-2 (N=8 per group), a) lung tissue was isolated and scored for presence and severity of alveolitis, alveolar damage, alveolar edema, alveolar hemorrhage, type II pneumocyte hyperplasia, bronchitis, bronchiolitis, peribronchial and perivascular cuffing. Sum of scores are presented as sum of LRT disease parameters. b) Four days after inoculation, nose tissue was isolated and scored for severity of inflammation (rhinitis).

Horizontal lines denote a pathology score of 0, indicating no histopathology. Symbols in red denote samples from hamsters with breakthrough lung viral load ($>10_2$ $TCID_{50}/g$) Comparisons were performed between the Ad26.COV2.S dose level groups, with the Ad26.Irr group by Mann-Whitney U-test. Statistical differences indicated by asterisks: *:$p<0.05$; :$p<0.01$; *:$p<0.001$. Ad26.Irr=Ad26 vector not encoding any SARS-CoV-2 antigens; LRT=lower respiratory tract; N=number of animals; VP=virus particles.

Figure 135A:
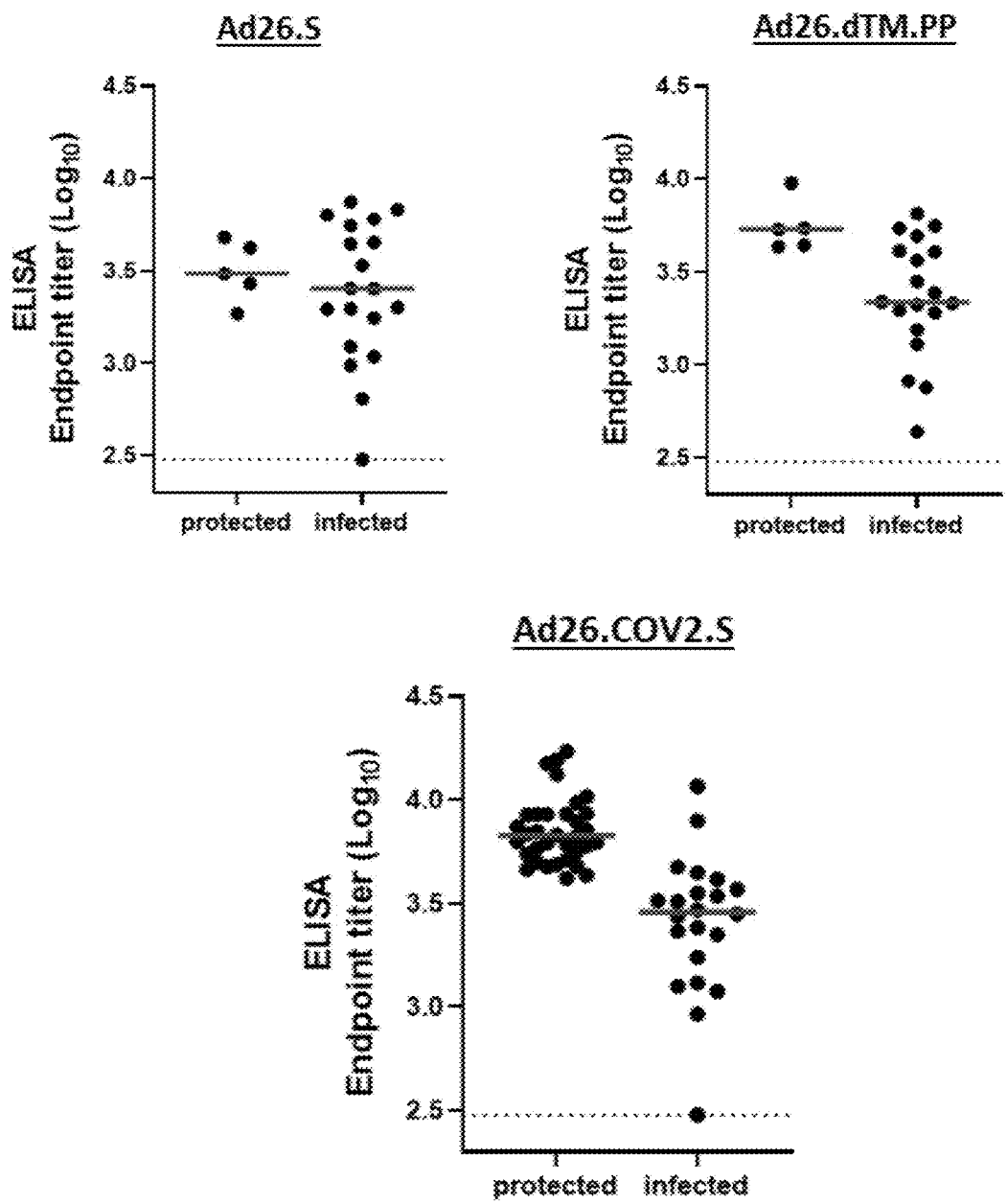
Figure 135B:
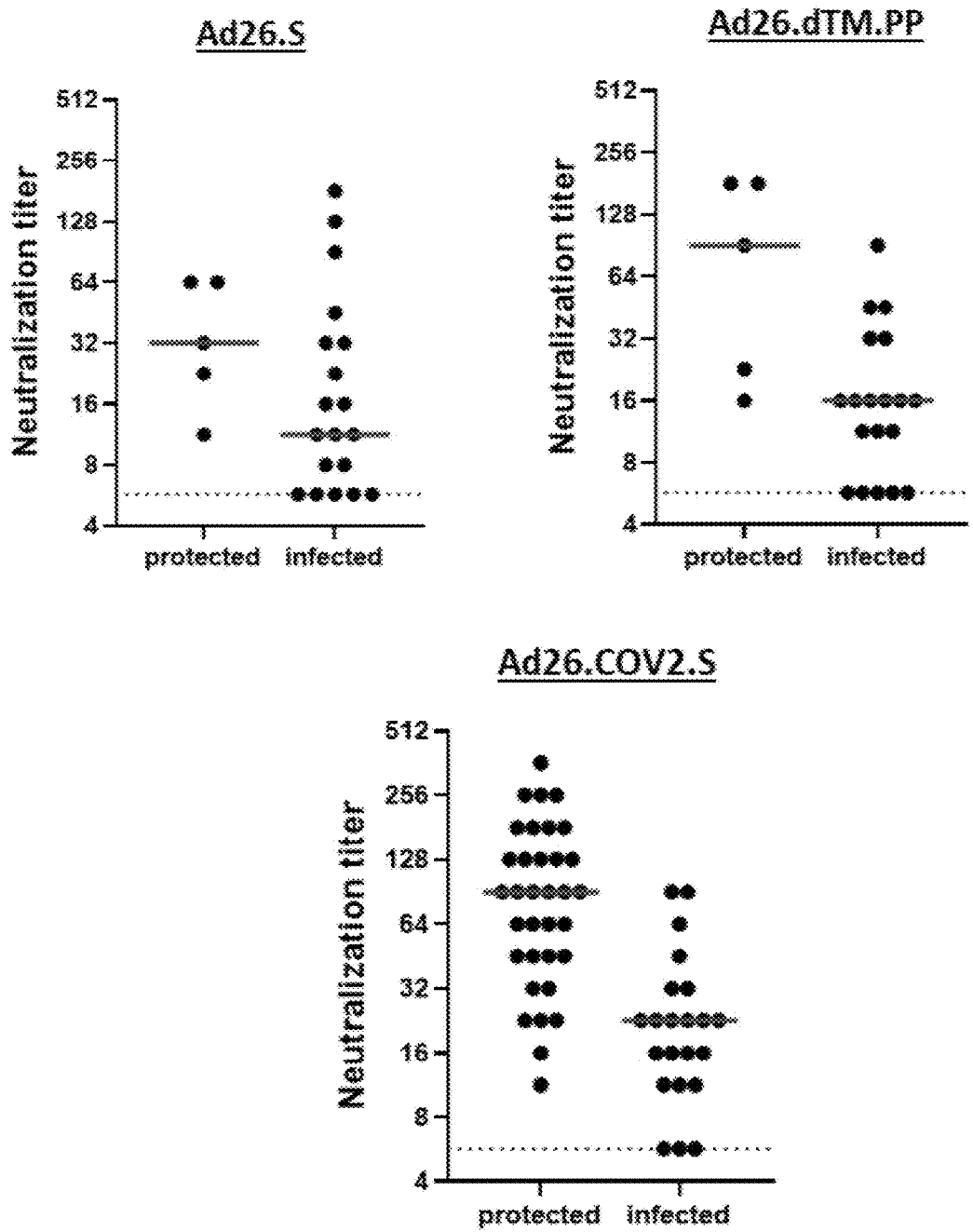
Figure 135C:
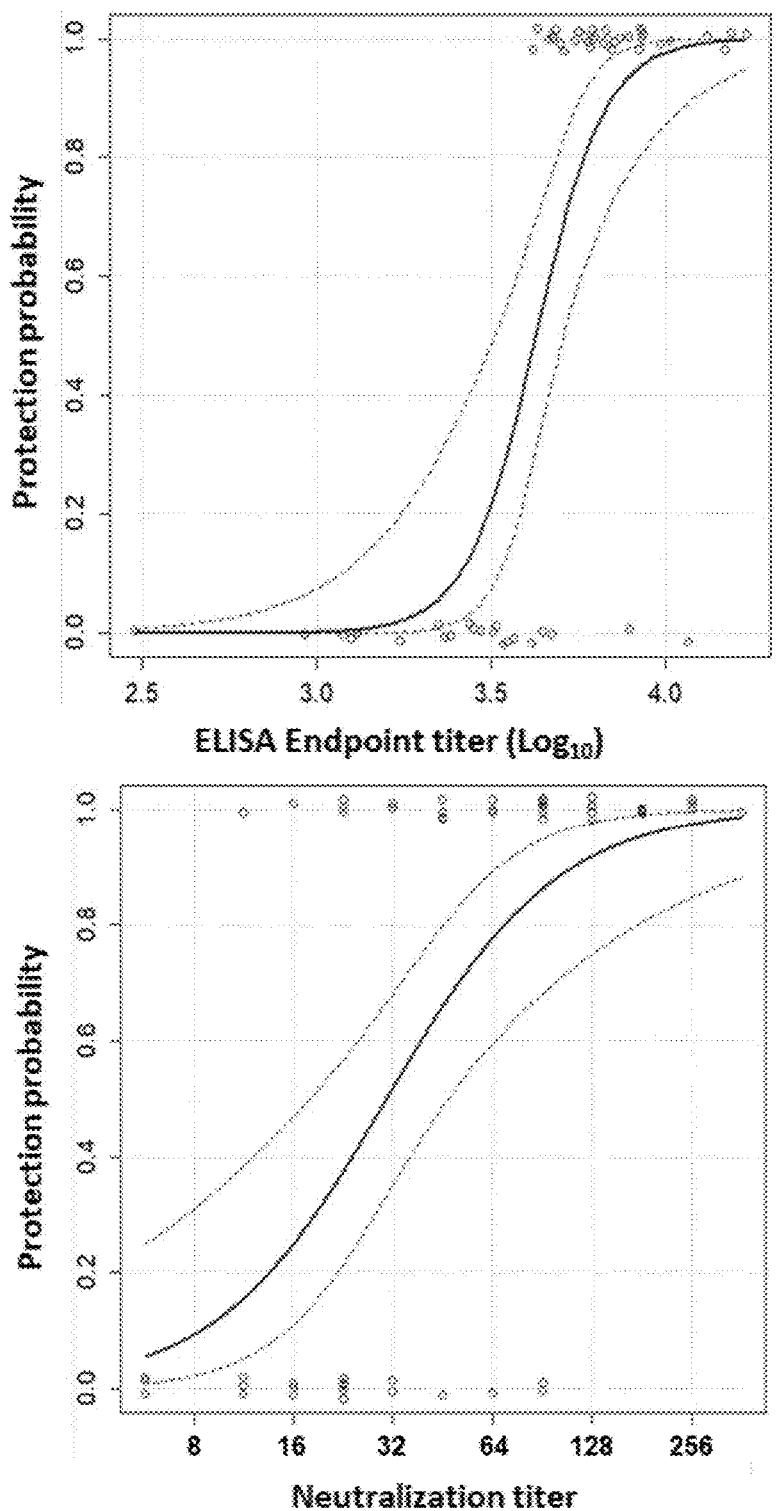

FIGS. 135A-135C: Binding and neutralizing antibodies correlate with protection. Protection per vaccine construct was defined as a viral load below $10^2$ $TCID_{50}/g$ in lung tissue, irrespective of vaccine regimen and dose level (see FIGS. 129A and B, and FIG. 133C). Syrian hamsters were immunized once, or twice, with $10^9$ or $10^{10}$ VP of Ad26.S or Ad26.dTM.PP (N=24 per construct), or $10^7$, $10^8$, $10^9$, $10^{10}$ VP Ad26.CoV.S (N=56). Hamsters were inoculated with $10^2$ $TCID_{50}$ SARS-CoV-2, and four days later sacrificed for virological analysis of lung tissue. Prior to virus inoculation serum samples were analyzed for (FIG. 135A) antibody binding titers and (FIG. 135B) virus neutralizing antibodies. Median antibody responses per group is indicated with horizontal lines. Dotted lines indicate the LLOD. (FIG. 135C) Protection probability logistic regression models were built with Firth's correction of binding and neutralizing antibody titers from pooled regimens and dose levels of Ad26.COV2.S. Dotted lines indicate the 95% confidence interval. LLOD=lower limit of detection; N=number of animals; $TCID_{50}/g$=50% tissue culture infective dose per gram tissue; VP=virus particles.

FIGS. 136A-136C: Rapid induction of binding and neutralizing antibodies following Ad26.COV2.S vaccination. (FIG. 136A) S-specific binding antibodies by ELISA, (FIG. 136B) RBD-specific binding antibodies by ELISA, and (FIG. 136C) pseudovirus neutralizing antibodies (psVNA) on day 1 and day 8 in recipients of the high dose (HD) and low dose (LD) Ad26.COV2.S or placebo (PL). Red bars reflect geometric mean titers (GMT). P values reflect two-sided Mann-Whitney tests.

Figure 137A:
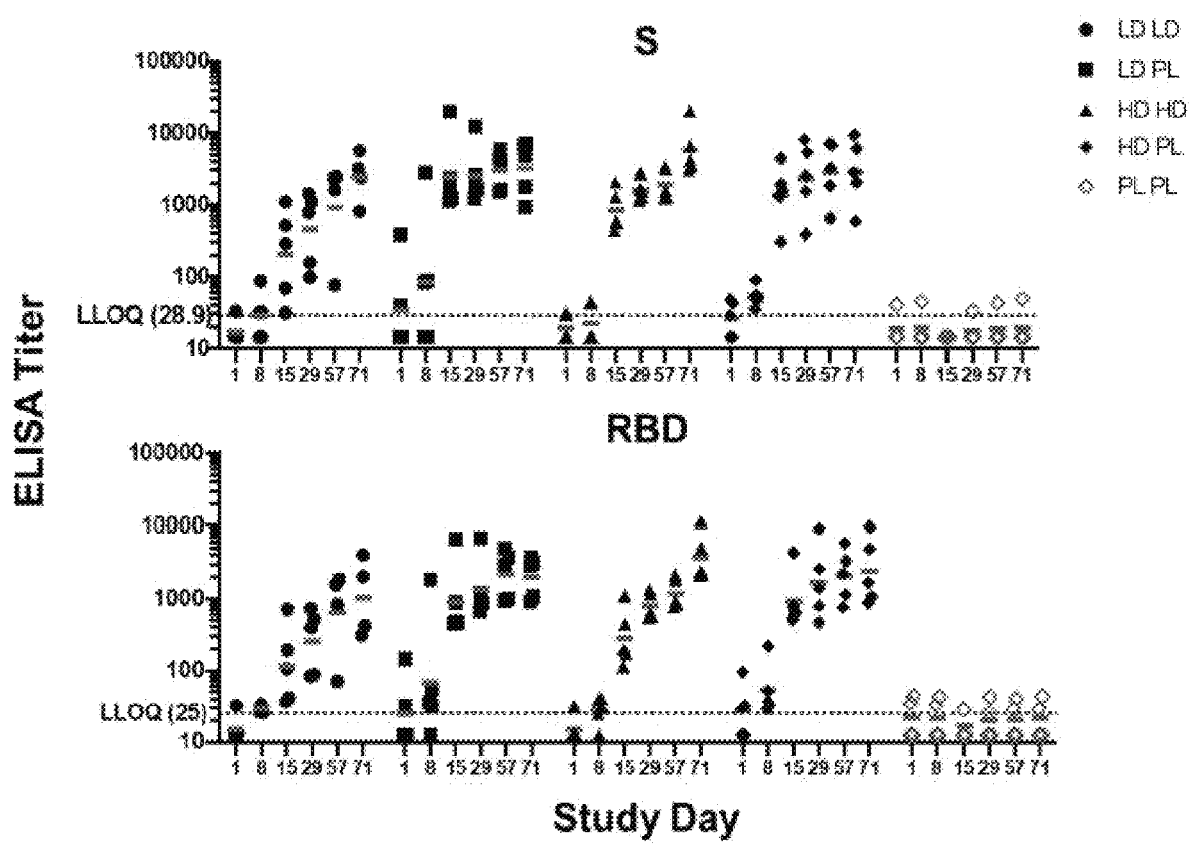
Figure 137B:
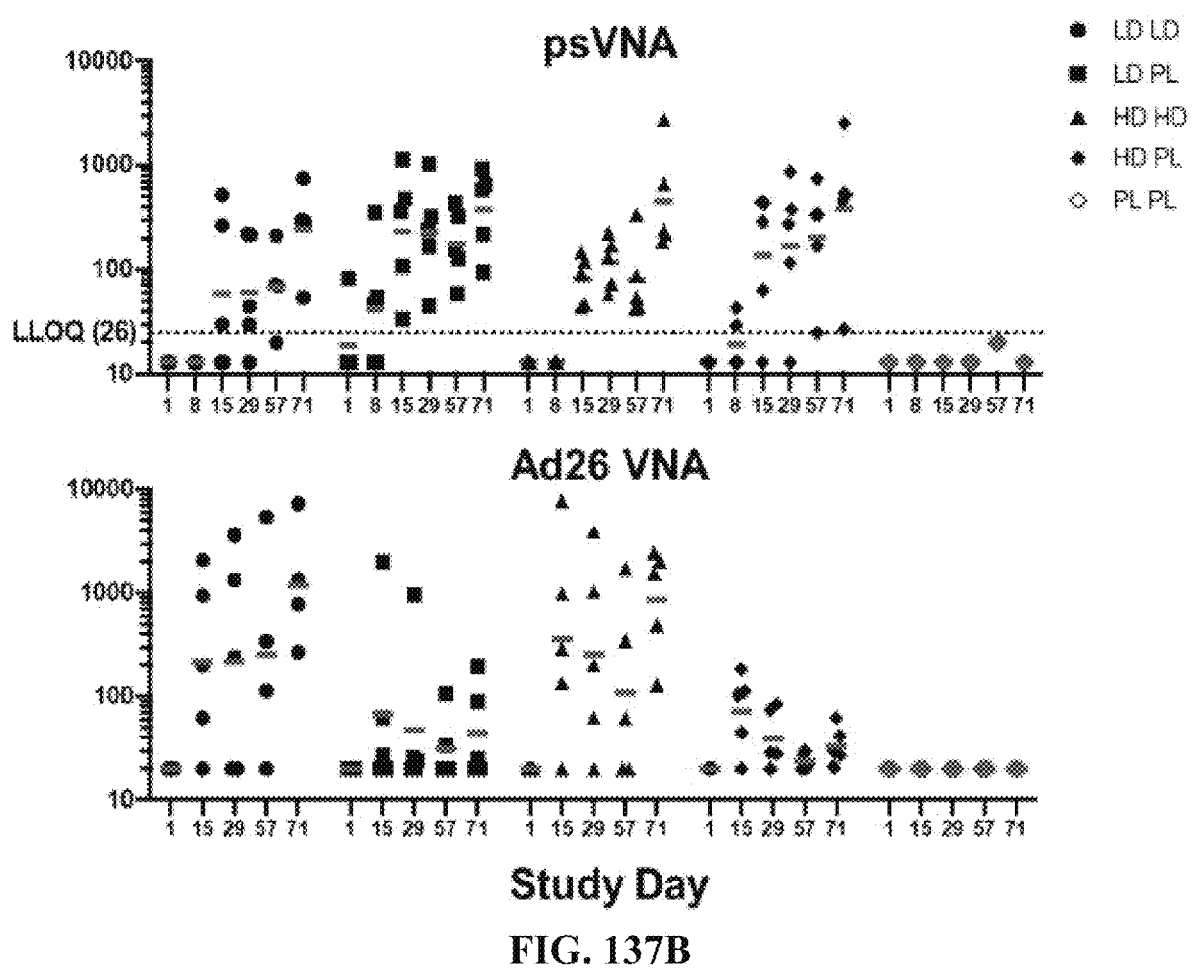

FIGS. 137A-137B: Kinetics and magnitude of binding and neutralizing antibodies following Ad26.COV2.S vaccination. (A) S- and RBD-specific binding antibodies by ELISA and (B) SARS-CoV-2 pseudovirus neutralizing antibody (psVNA) and Ad26 virus neutralizing antibody (Ad26 VNA) responses following Ad26.COV2.S vaccination. LD, low dose; HD, high dose; PL, placebo. Red bars reflect geometric mean titers (GMT). Dotted lines reflect lower limits of quantitation.

Figure 138:
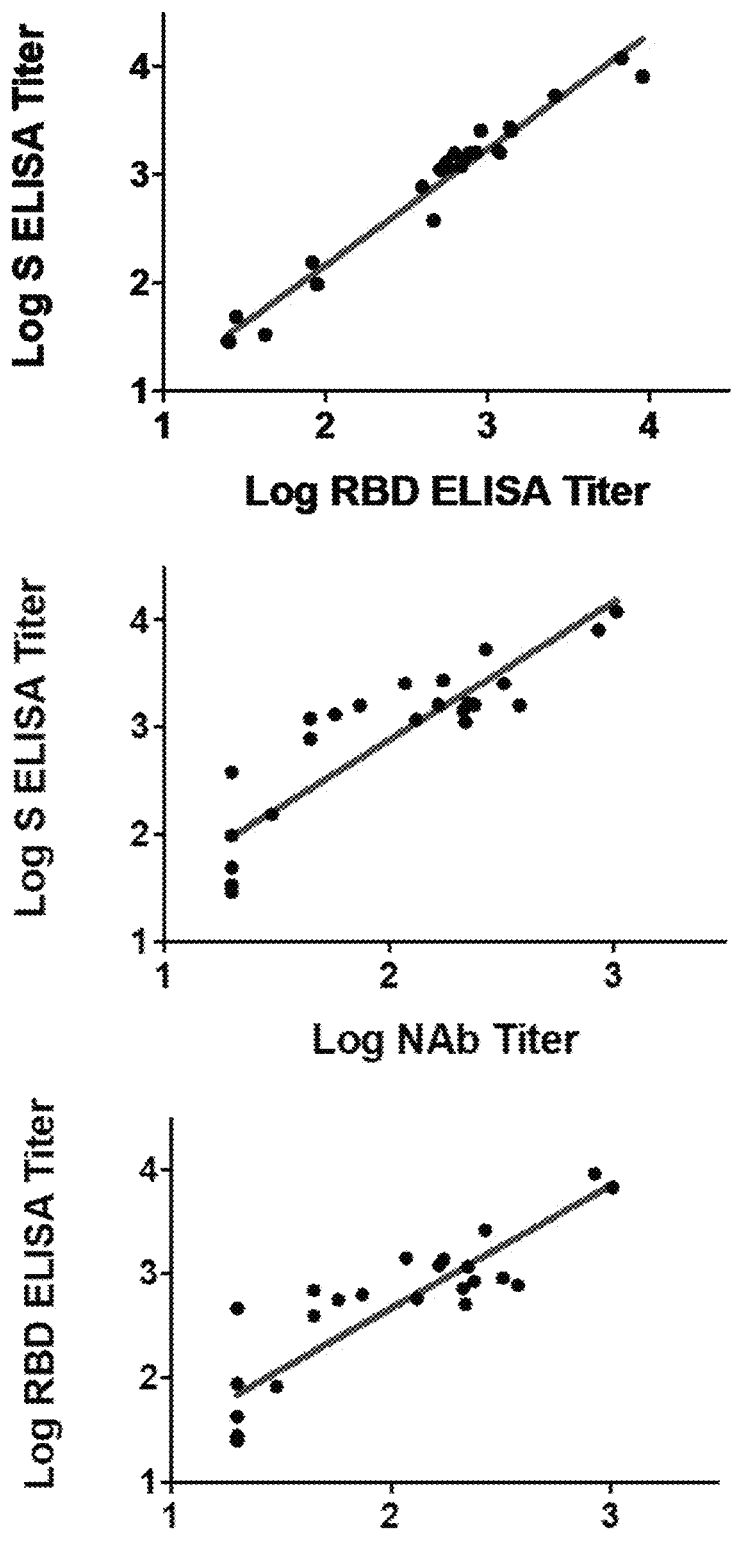

FIG. 138: Correlations of humoral immune responses. Correlations of $\log_{10}$ S-specific ELISA titers, $\log_{10}$ RBD-specific ELISA titers, and log 10 neutralizing antibody (NAb) titers on day 29. P and R values reflect two-sided Spearman rank-correlation tests.

Figure 139A:
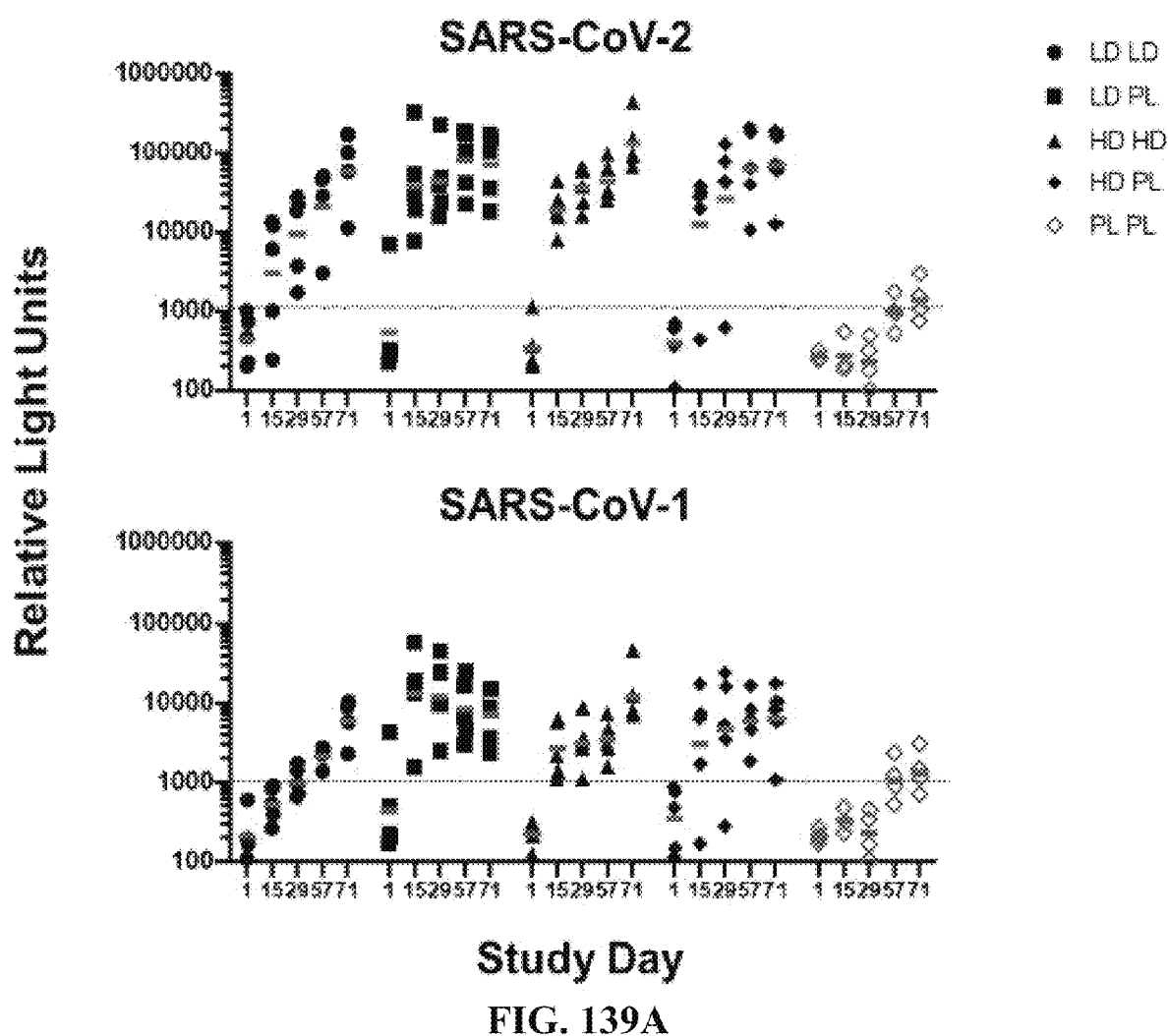
Figure 139B:
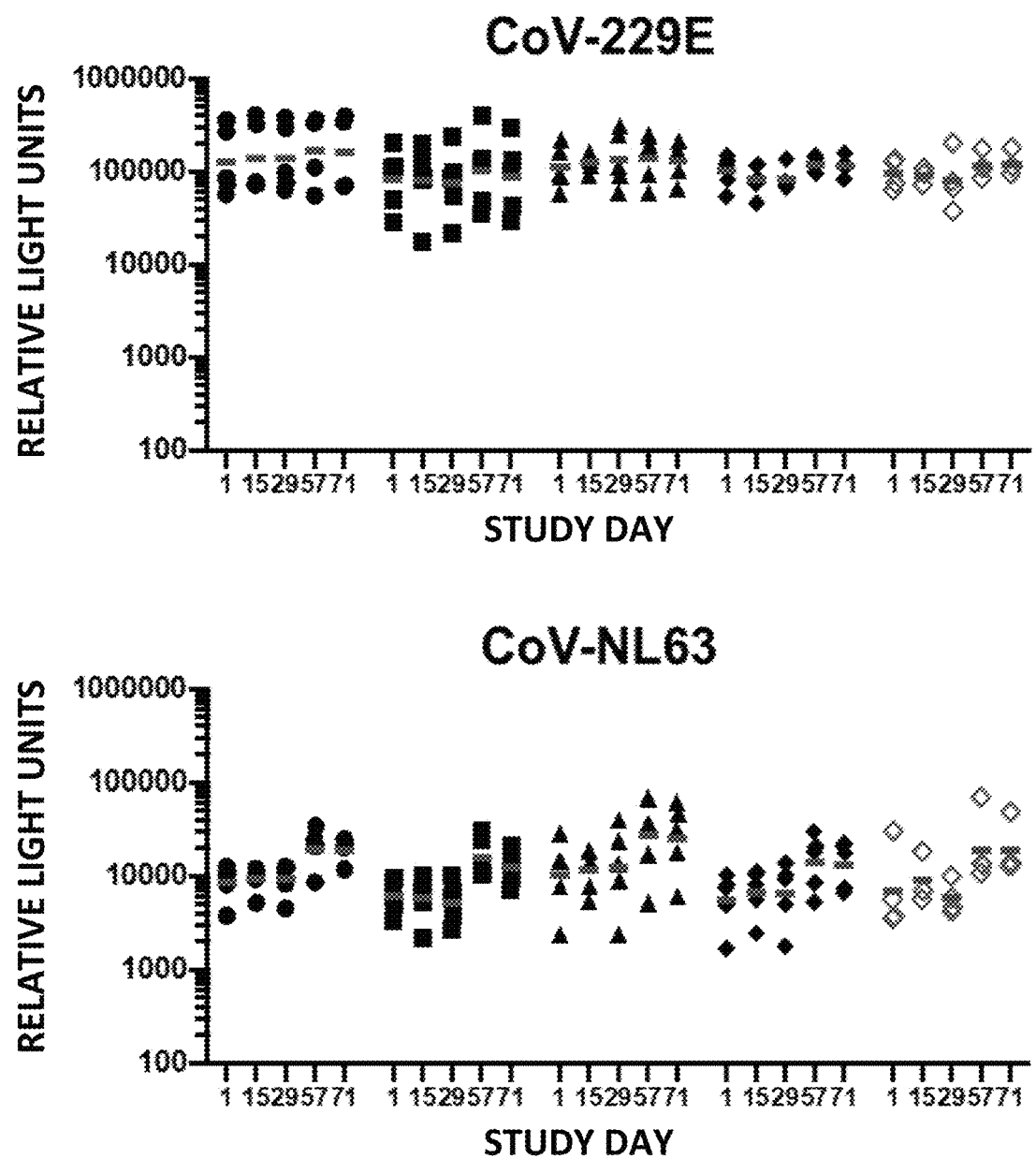

FIGS. 139A-139B: Antibody cross-reactivity following Ad26.COV2.S vaccination. Electrochemiluminescence assay (Meso Scale Discovery SARS-CoV-2 IgG Panel 2; K15369U-2) assessing binding antibody responses to the S proteins from (FIG. 139A) SARS-CoV-2 and SARS-CoV-1 as well as (FIG. 139B) CoV-229E, CoV-HKU1, CoV-NL63, and CoV-OC43 following Ad26.COV2.S vaccination. LD, low dose; HD, high dose; PL, placebo. Red bars reflect geometric mean responses. Dotted lines reflect lower limits of quantitation.

Figure 140A:
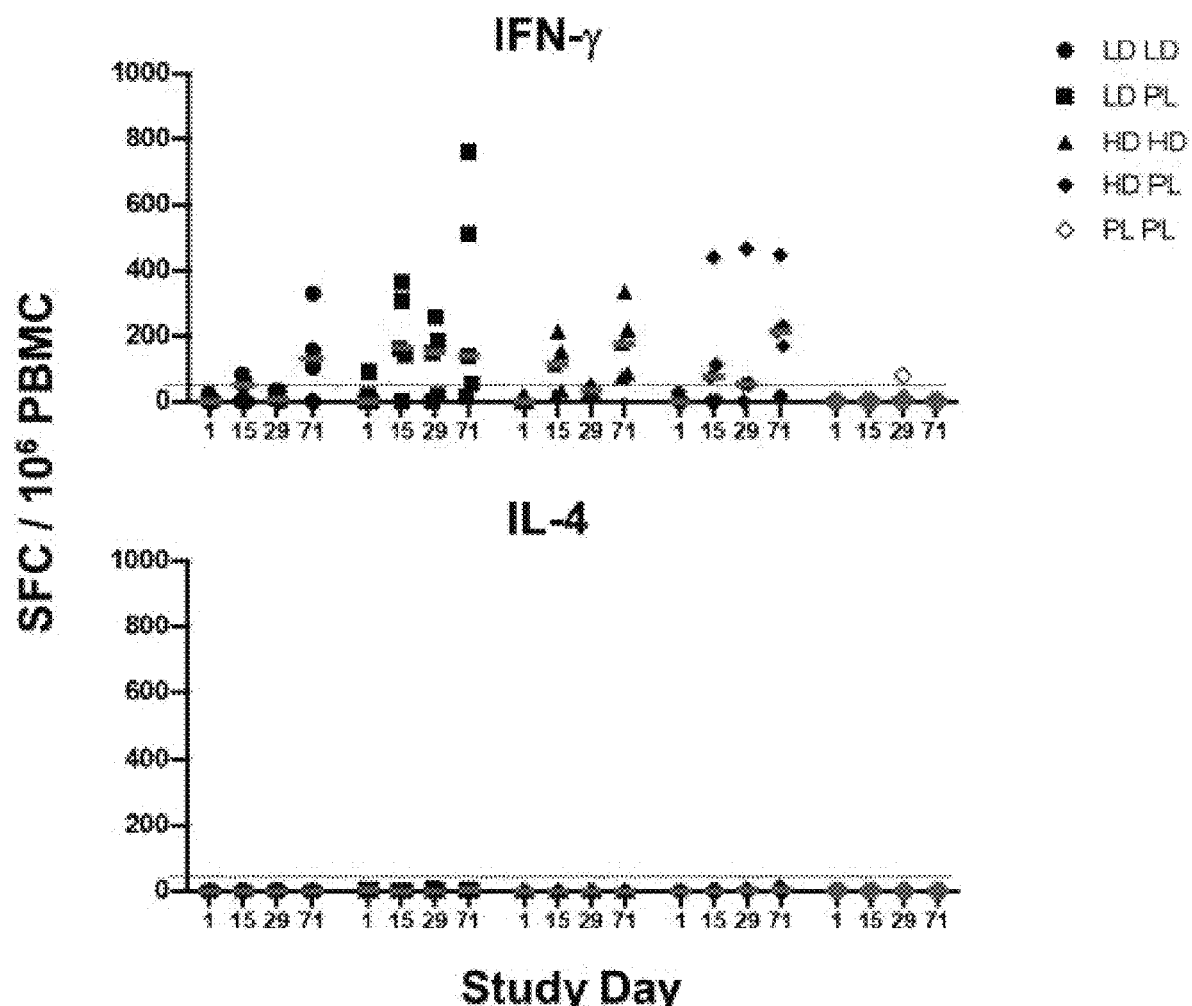
Figure 140B:
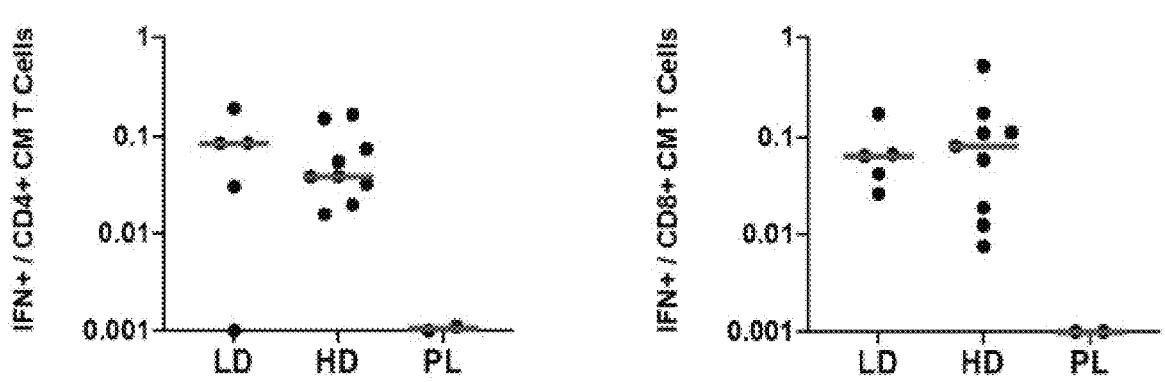

FIGS. 140A-140B: Kinetics and magnitude of cellular immune responses following Ad26.COV2.S vaccination. (FIG. 140A) IFN-γ and IL-4 ELISPOT responses and (FIG. 140B) IFN-γ central memory CD27+CD45RA− CD4+ and CD8+ T cell responses by ICS assays following Ad26.COV2.S vaccination. ICS assays were performed in a subset of participants with sufficient peripheral blood mononuclear cells (PBMCs) on day 71/85. SFC, spot-forming cells; LD, low dose; HD, high dose; PL, placebo. Red bars reflect geometric mean responses. Dotted lines reflect lower limits of quantitation.

Figure 141:
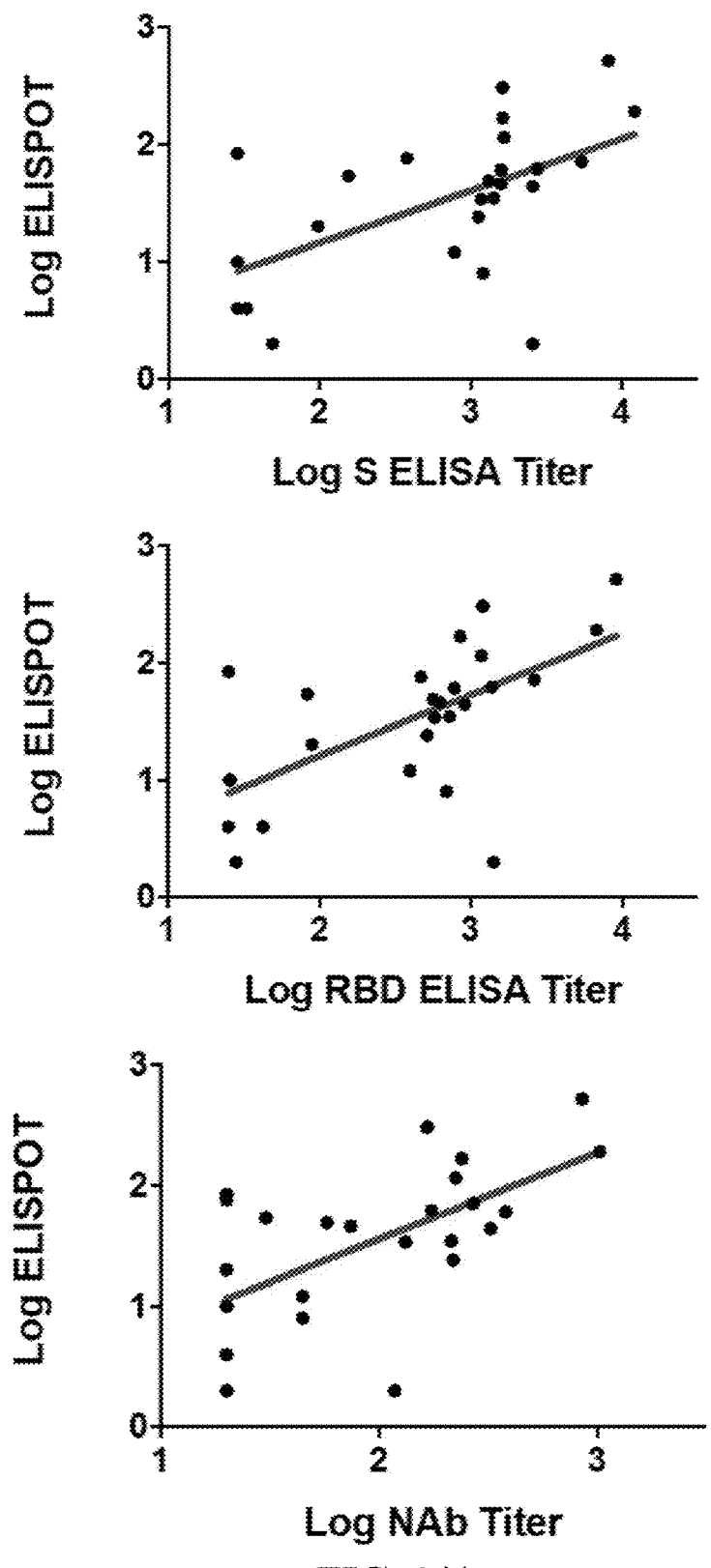

FIG. 141: Correlations of cellular and humoral immune responses. Correlations of $\log_{10}$ ELISPOT responses with login S-specific ELISA titers, $\log_{10}$ RBD-specific ELISA titers, and log 10 neutralizing antibody (NAb) titers on day 29. P and R values reflect two-sided Spearman rank-correlation tests.

Figure 142:
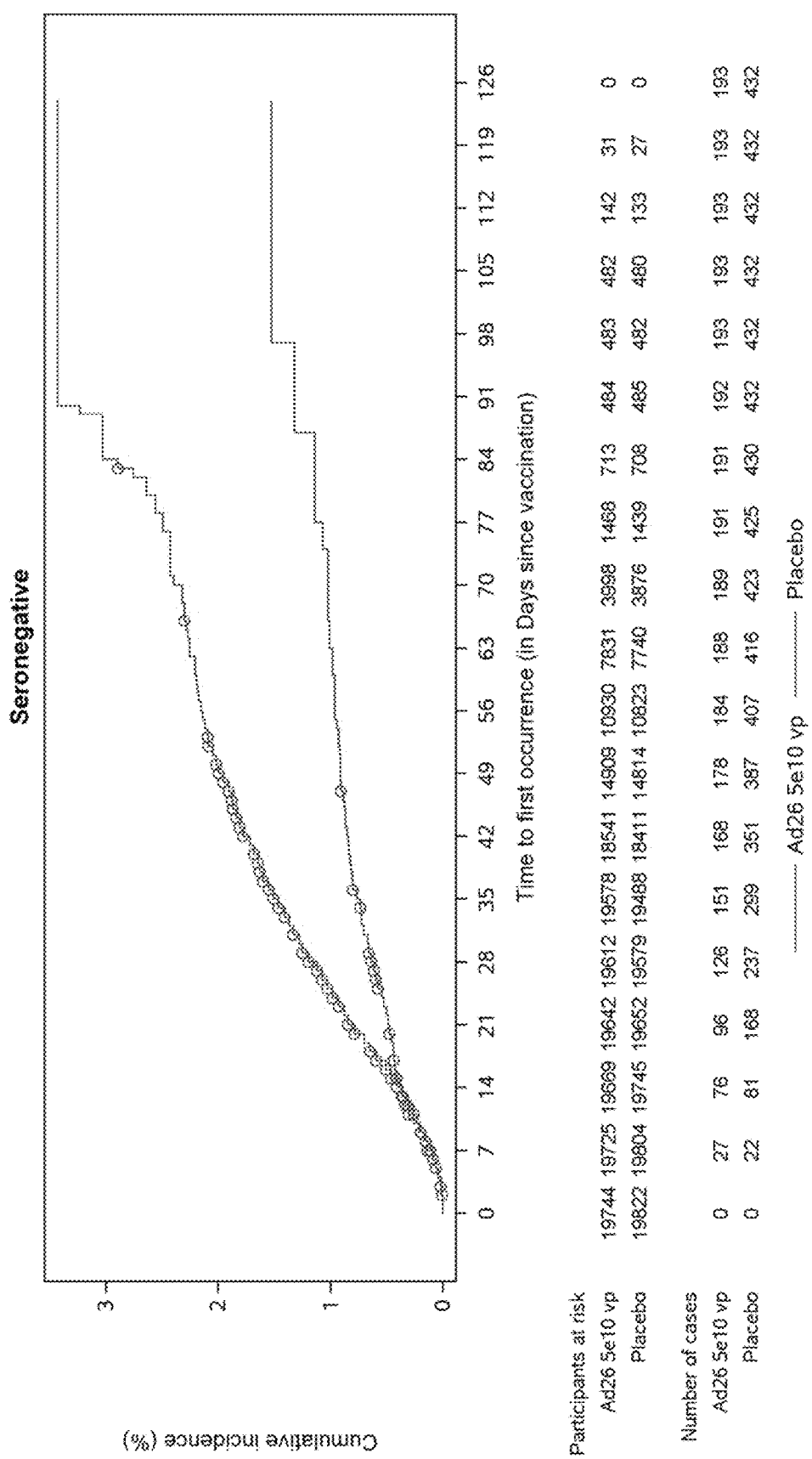

FIG. 142: Cumulative Incidence of Molecularly Confirmed Moderate to Severe/Critical COVID-19 Cases with Onset at Least 1 Day after Vaccination, Full Analysis Set.

Figure 143:
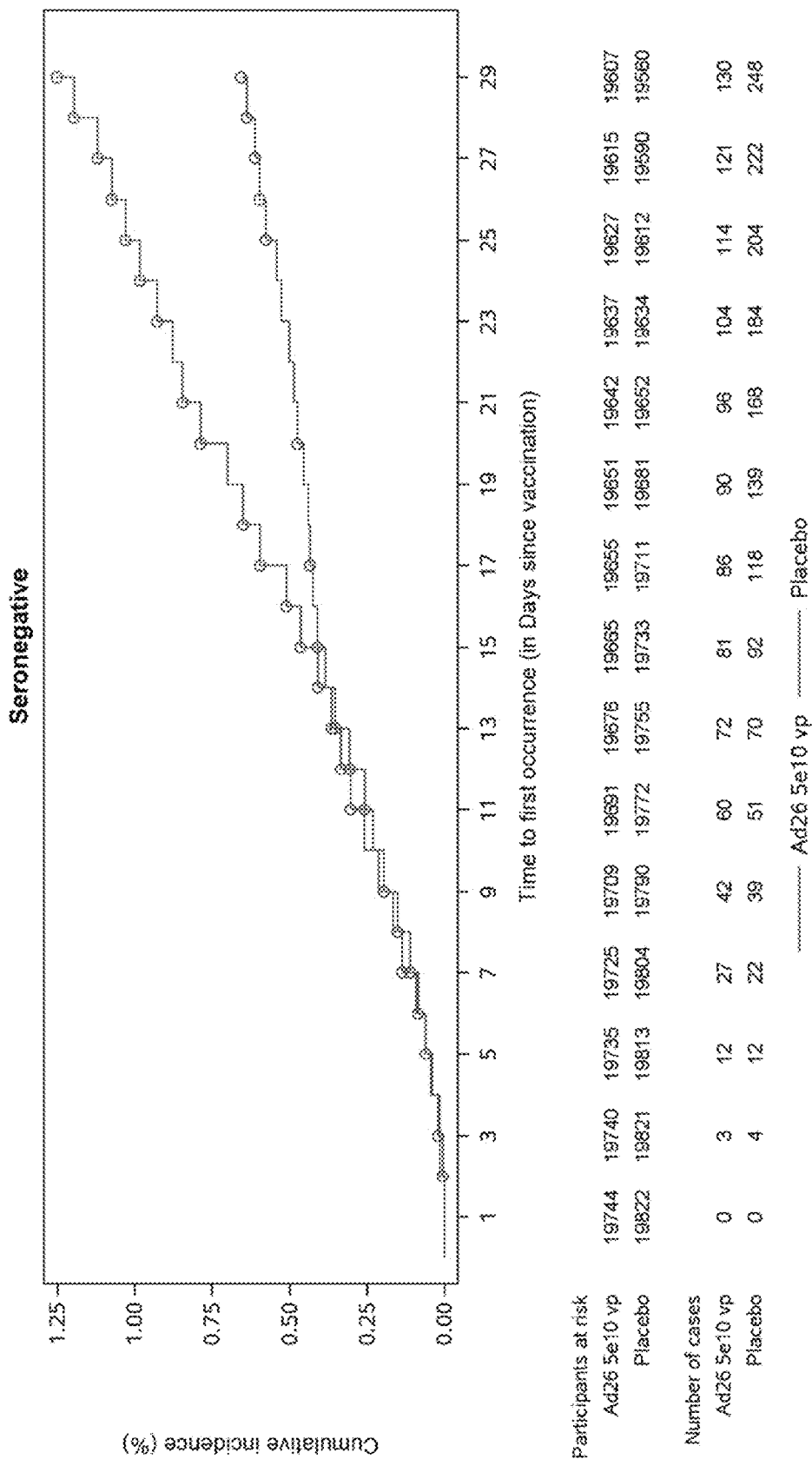

FIG. 143: Cumulative Incidence of Molecularly Confirmed Moderate to Severe/Critical COVID-19 Cases with Onset at Least 1 Day After Vaccination Until Day 29 by Serostatus; Full Analysis Set.

Figure 144:
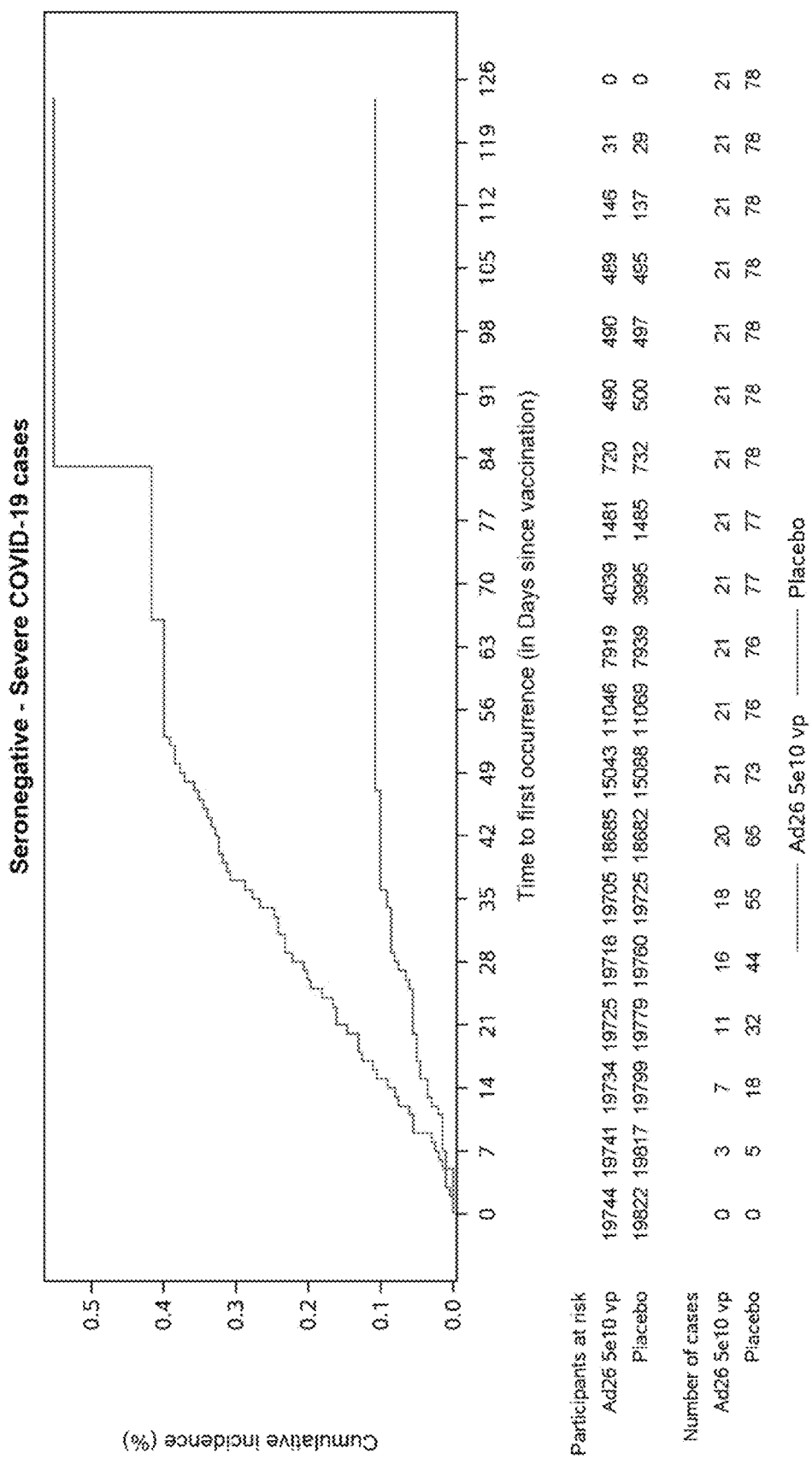

FIG. 144: Cumulative Incidence of Molecularly Confirmed Severe/Critical COVID-19 Cases with Onset at Least 1 Day after Vaccination, Full Analysis Set.

Figure 145:
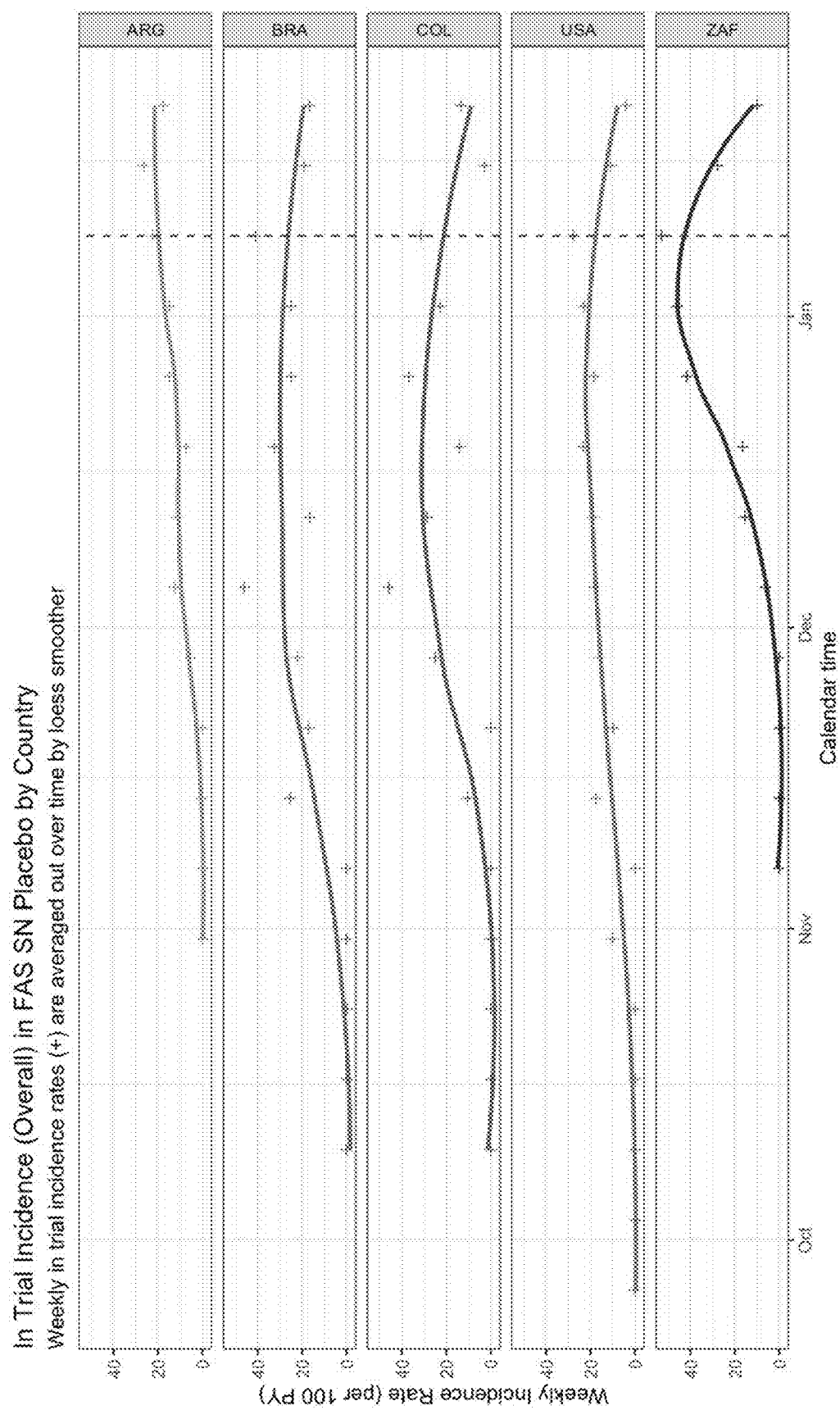

FIG. 145: Force of infection. Placebo COVID-19 incidence rate in different countries.

Figure 146:
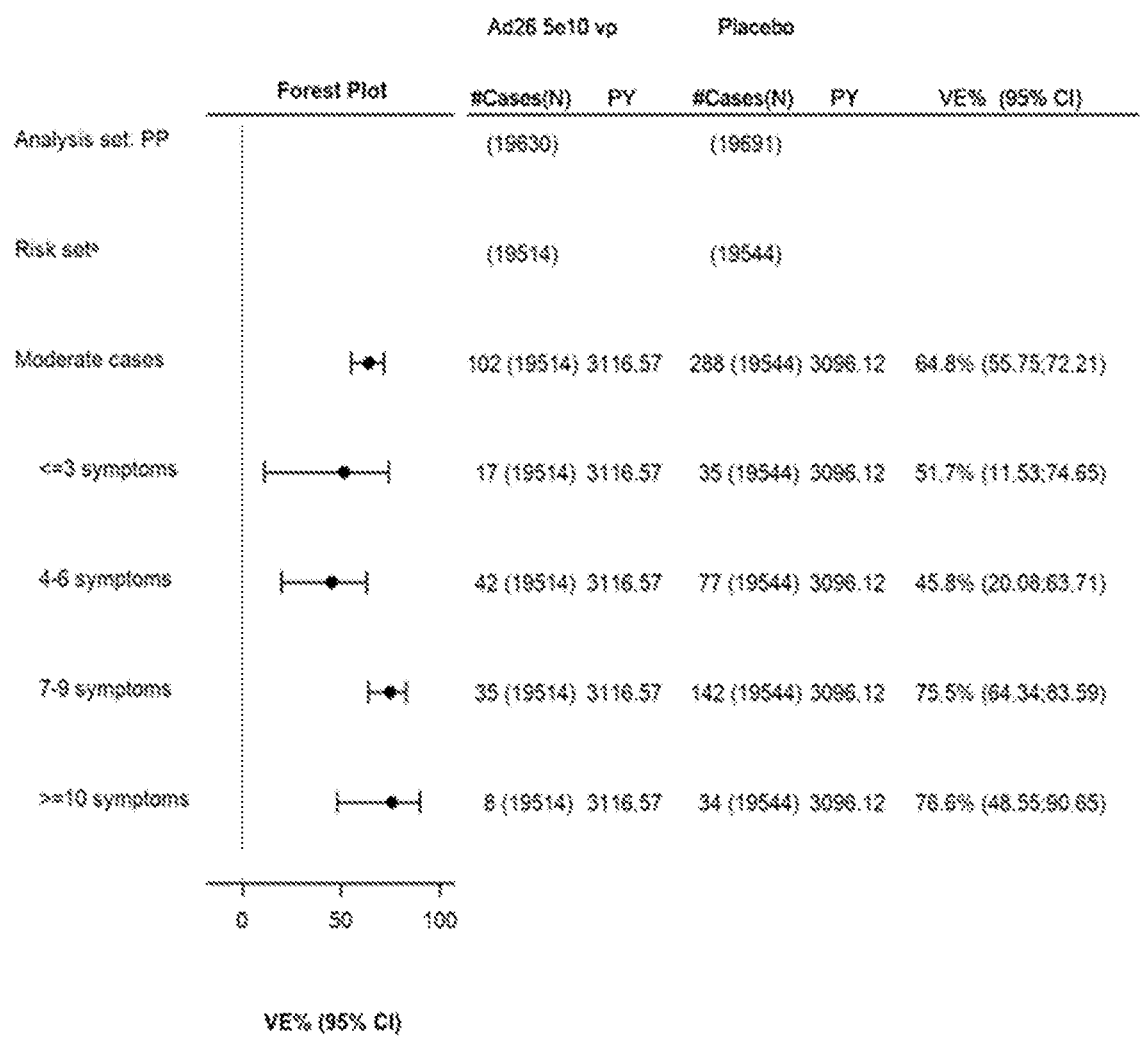
Figure 147:
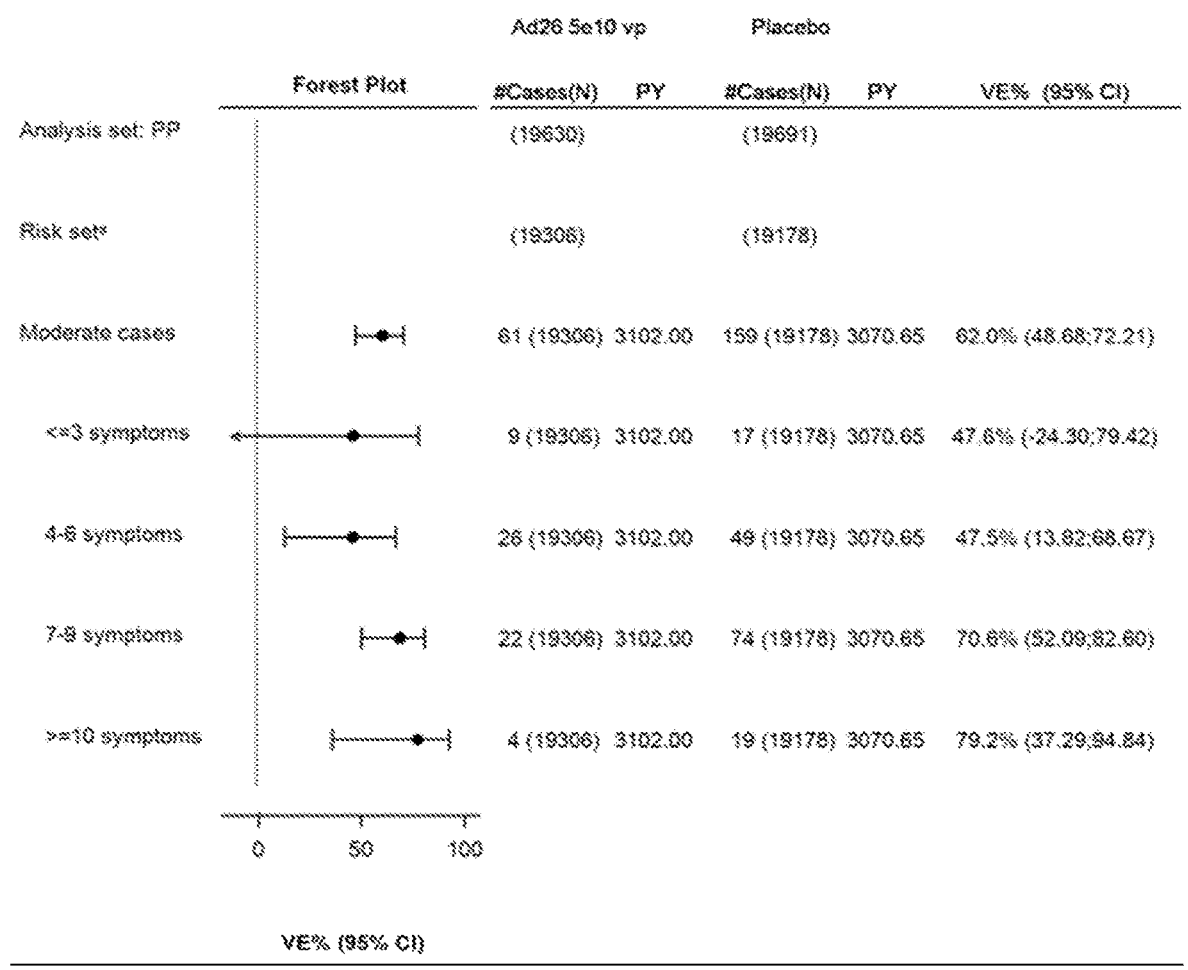

FIG. 146: Summary of vaccine efficacy against moderate COVID-19 with onset at least 14 days after vaccination; per protocol set by number of moderate symptoms:

FIG. 147: Summary of vaccine efficacy against moderate COVID-19 with onset at least 28 days after vaccination; per protocol set (Study VAC31518COV3001) by number of moderate symptom.

DETAILED DESCRIPTION

Definitions

As used herein, the term "about" means+/−10% of the recited value.

The terms "adenovirus vector" and "adenoviral vector" are used interchangeably and refer to a genetically-engineered adenovirus that is designed to insert a polynucleotide of interest (e.g., a polynucleotide encoding a 2019-nCoV immunogen) into a eukaryotic cell, such that the polynucleotide is subsequently expressed. Examples of adenoviruses that can be used as a viral vector include those having, or derived from, the serotypes Ad2, Ad5, Ad11, Ad12, Ad24, Ad26, Ad34, Ad35, Ad40, Ad48, Ad49, Ad50, Ad52 (e.g., RhAd52), Ad59 (e.g., RhAd59), and Pan9 (also known as AdC68); these vectors can be derived from, for example, human, chimpanzee, or rhesus adenoviruses. In some embodiments, the adenovirus is Ad26.

The term "adjuvant" refers to a pharmacological or immunological agent that modifies the effect of other agents (e.g., vaccines) while having few if any direct effects when given by itself. They are often included in vaccines to enhance the recipient's immune response to a supplied antigen while keeping the injected foreign material at a minimum.

As used herein, by "administering" is meant a method of giving a dosage of a pharmaceutical composition (e.g., an immunogenic composition (e.g., a vaccine (e.g., a Wuhan coronavirus (2019-nCoV) vaccine))) to a subject. The compositions utilized in the methods described herein can be administered, for example, intramuscularly, intravenously, intradermally, percutaneously, intraarterially, intraperitoneally, intralesionally, intracranially, intraarticularly, intraprostatically, intrapleurally, intratracheally, intranasally, intravitreally, intravaginally, intrarectally, topically, intratumorally, peritoneally, subcutaneously, subconjunctivally, intravesicularlly, mucosally, intrapericardially, intraumbilically, intraocularly, orally, topically, locally, by inhalation, by injection, by infusion, by continuous infusion, by localized perfusion bathing target cells directly, by catheter, by lavage, by gavage, in cremes, or in lipid compositions. The preferred method of administration can vary depending on various factors (e.g., the components of the composition being administered and the severity of the condition being treated).

The terms "antibody" and "immunoglobulin (Ig)" are used interchangeably in the broadest sense and include monoclonal antibodies (e.g., full-length or intact monoclonal antibodies), polyclonal antibodies, multivalent antibodies, multispecific antibodies (e.g., bispecific antibodies so long as they exhibit the desired biological activity) and may also include certain antibody fragments. An antibody typically comprises both "light chains" and "heavy chains." The light chains of antibodies (immunoglobulins) from any vertebrate species can be assigned to one of two clearly distinct types, called kappa (κ) and lambda (λ), based on the amino acid sequences of their constant domains. Depending on the amino acid sequence of the constant domain of their heavy chains, immunoglobulins can be assigned to different classes. There are five major classes of immunoglobulins: IgA, IgD, IgE, IgG, and IgM, and several of these can be further divided into subclasses (isotypes), e.g., IgG1, IgG2, IgG3, IgG4, IgA1, and IgA2. The heavy chain constant domains that correspond to the different classes of immunoglobulins are called α, δ, ε, γ, and μ, respectively. The subunit structures and three-dimensional configurations of different classes of immunoglobulins are well known.

The term "codon" as used herein refers to any group of three consecutive nucleotide bases in a given messenger RNA molecule, or coding strand of DNA, that specifies a particular amino acid or a starting or stopping signal for translation. The term codon also refers to base triplets in a DNA strand.

Throughout this specification and claims, the word "comprise," or variations such as "comprises" or "comprising," will be understood to imply the inclusion of a stated integer or group of integers but not the exclusion of any other integer or group of integers.

The term "convalescent" as used herein refers to subjects who have recovered or are recovering from a coronavirus infection (e.g., 2019-nCoV). A "cohort of convalescent humans" refers to a group of humans that share common characteristics (e.g., sex, age, weight, medical history, race, ethnicity, or environment) and have recovered or are recovering from a coronavirus infection (e.g., 2019-nCoV). Preferably, a cohort of convalescent humans will share common characteristics with a subject having a risk of 2019-nCoV infection or suspected of being susceptible to a coronavirus infection. Preferably, samples from convalescent humans will be obtained at least 7 days after documented recovery (e.g., determined with a negative nasal swab).

The terms "ectodomain" and "extracellular domain" refer to the portion of a coronavirus Spike polypeptide that extends beyond the transmembrane domain into the extracellular space. The ectodomain mediates binding of a Spike polypeptide to one or more coronavirus receptors (e.g., ACE2). For instance, an ectodomain includes the S1 domain (e.g., SEQ ID NO: 4) and RBD (e.g., SEQ ID NO: 5) of a Spike polypeptide.

A "gene delivery vehicle" is defined as any molecule that can carry inserted polynucleotides into a host cell. Examples of gene delivery vehicles are liposomes, biocompatible polymers, including natural polymers and synthetic polymers; lipoproteins; polypeptides; polysaccharides; lipopolysaccharides; artificial viral envelopes; metal particles; and bacteria, or viruses, such as baculovirus, adenovirus and retrovirus, bacteriophage, cosmid, plasmid, fungal vectors and other recombination vehicles typically used in the art that have been described for expression in a variety of eukaryotic and prokaryotic hosts, and may be used for gene therapy as well as for simple protein expression.

"Gene delivery," "gene transfer," and the like as used herein, are terms referring to the introduction of an exogenous polynucleotide (sometimes referred to as a "transgene") into a host cell, irrespective of the method used for the introduction. Such methods include a variety of techniques such as, for example, vector-mediated gene transfer (e.g., viral infection/transfection, or various other protein-based or lipid-based gene delivery complexes) as well as techniques facilitating the delivery of "naked" polynucleotides (such as electroporation, "gene gun" delivery and various other techniques used for the introduction of polynucleotides). The introduced polynucleotide may be stably or transiently maintained in the host cell. Stable maintenance typically requires that the introduced polynucleotide either contains an origin of replication compatible with the host cell or integrates into a replicon of the host cell such as an extrachromosomal replicon (e.g., a plasmid) or a nuclear or mitochondrial chromosome. A number of vectors are capable of mediating transfer of genes to mammalian cells.

By "gene product" is meant to include mRNAs or other nucleic acids (e.g., microRNAs) transcribed from a gene, as well as polypeptides translated from those mRNAs. In some embodiments, the gene product is from a virus (e.g., a 2019-nCoV) and may include, for example, any one or more of the viral proteins, or fragments thereof, described herein.

By "heterologous nucleic acid molecule" is meant a nucleotide sequence that may encode proteins derived or obtained from pathogenic organisms, such as viruses, which may be incorporated into a polynucleotide or vector. Heterologous nucleic acids may also encode synthetic or artificial proteins, such as immunogenic epitopes, constructed to induce immunity. An example of a heterologous nucleic acid molecule is one that encodes one or more immunogenic peptides or polypeptides derived from a coronavirus (e.g., 2019-nCoV). The heterologous nucleic acid molecule is one that is not normally associated with the other nucleic acid molecules found in the polynucleotide or vector into which the heterologous nucleic acid molecule is incorporated.

The term "host cell," refers to cells into which an exogenous nucleic acid has been introduced, including the progeny of such cells. Host cells include "transformants" and "transformed cells," which include the primary transformed cell and progeny derived therefrom without regard to the number of passages. Host cells include cells within the body of a subject (e.g., a mammalian subject (e.g., a human)) into which an exogenous nucleic acid has been introduced.

By "immunogen" is meant any polypeptide that can induce an immune response in a subject upon administration. In some embodiments, the immunogen is encoded by a nucleic acid molecule that may be incorporated into, for example, a polynucleotide or vector, for subsequent expression of the immunogen (e.g., a gene product of interest, or fragment thereof (e.g., a polypeptide)).

The term "immunogenic composition" as used herein, is defined as material used to provoke an immune response and may confer immunity after administration of the immunogenic composition to a subject.

The term "immunostimulatory agent" refers to substances (e.g., drugs and nutrients) that stimulate the immune system by inducing activation or increasing activity of any of its components. An immunostimulatory agent includes a cytokine (e.g., the granulocyte macrophage colony-stimulating factor) and interferon (e.g., IFN-α and/or IFN-γ).

By "isolated" is meant separated, recovered, or purified from a component of its natural environment. For example, a nucleic acid molecule or polypeptide may be isolated from a component of its natural environment by 1% (2%, 3%, 4%, 5%, 6%, 7%, 8% 9% 10%, 20%, 30%, 40%, 50%, 60% 70%, 80%, or 90%) or more.

By "pharmaceutical composition" is meant any composition that contains a therapeutically or biologically active agent, such as an immunogenic composition or vaccine (e.g., a 2019-nCoV nucleic acid molecule, vector, and/or polypeptide), preferably including a nucleotide sequence encoding an antigenic gene product of interest, or fragment thereof, that is suitable for administration to a subject and that treats or prevents a disease (e.g., 2019-nCoV infection) or reduces or ameliorates one or more symptoms of the disease (e.g., 2019-nCoV viral titer, viral spread, infection, and/or cell fusion)). For the purposes of this invention, pharmaceutical compositions include vaccines, and pharmaceutical compositions suitable for delivering a therapeutic or biologically active agent can include, for example, tablets, gelcaps, capsules, pills, powders, granulates, suspensions, emulsions, solutions, gels, hydrogels, oral gels, pastes, eye drops, ointments, creams, plasters, drenches, delivery devices, suppositories, enemas, injectables, implants, sprays, or aerosols. Any of these formulations can be prepared by well-known and accepted methods of art. See, for example, *Remington: The Science and Practice of Pharmacy* (21$^{st}$ ed.), ed. A. R. Gennaro, Lippincott Williams & Wilkins, 2005, and *Encyclopedia of Pharmaceutical Technology*, ed. J. Swarbrick, Informa Healthcare, 2006, each of which is hereby incorporated by reference.

The terms "linked" or "links" or "link" as used herein are meant to refer to the covalent joining of two amino acid sequences or two nucleic acid sequences together through peptide or phosphodiester bonds, respectively, such joining can include any number of additional amino acid or nucleic acid sequences between the two amino acid sequences or nucleic acid sequences that are being joined.

"Nucleic acid molecule" or "polynucleotide," as used interchangeably herein, refer to polymers of nucleotides of any length, and include DNA and RNA. The nucleotides can be deoxyribonucleotides, ribonucleotides, modified nucleotides or bases, and/or their analogs, or any substrate that can be incorporated into a polymer by DNA or RNA polymerase, or by a synthetic reaction. A polynucleotide may comprise modified nucleotides, such as methylated nucleotides and their analogs. If present, modification to the nucleotide structure may be imparted before or after assembly of the polymer. The sequence of nucleotides may be interrupted by non-nucleotide components. A polynucleotide may be further modified after synthesis, such as by conjugation with a label.

A "nucleic acid vaccine" refers to a vaccine that includes a heterologous nucleic acid molecule under the control of a promoter for expression in a subject. The heterologous nucleic acid molecule can be incorporated into an expression vector, such as a plasmid. A "DNA vaccine" refers to a vaccine in which the nucleic acid is DNA. An "RNA vaccine" refers to a vaccine in which the nucleic acid is RNA (e.g., an mRNA).

A nucleic acid is "operably linked" when it is placed into a structural or functional relationship with another nucleic acid sequence. For example, one segment of DNA may be operably linked to another segment of DNA if they are positioned relative to one another on the same contiguous DNA molecule and have a structural or functional relationship, such as a promoter or enhancer that is positioned relative to a coding sequence so as to facilitate transcription of the coding sequence; a ribosome binding site that is positioned relative to a coding sequence so as to facilitate translation; or a pre-sequence or secretory leader that is positioned relative to a coding sequence so as to facilitate expression of a pre-protein (e.g., a pre-protein that participates in the secretion of the encoded polypeptide). In other examples, the operably linked nucleic acid sequences are not contiguous, but are positioned in such a way that they have a functional relationship with each other as nucleic acids or as proteins that are expressed by them. Enhancers, for example, do not have to be contiguous. Linking may be accomplished by ligation at convenient restriction sites or by using synthetic oligonucleotide adaptors or linkers.

By "optimized" is meant an immunogenic polypeptide that is not a naturally-occurring peptide, polypeptide, or protein, such as a non-naturally occurring viral polypeptide (e.g., a Spike polypeptide). Optimized viral polypeptide sequences are initially generated by modifying the amino acid sequence of one or more naturally-occurring viral gene products (e.g., peptides, polypeptides, and proteins) to increase the breadth, intensity, depth, or longevity of the antiviral immune response (e.g., cellular or humoral immune responses) generated upon immunization (e.g., when incorporated into a composition, e.g., vaccine) of a subject (e.g., a human). Thus, the optimized viral polypeptide may correspond to a "parent" viral gene sequence; alternatively, the optimized viral polypeptide may not correspond to a specific "parent" viral gene sequence but may correspond to analogous sequences from various strains or quasi-species of a virus. Modifications to the viral gene sequence that can be included in an optimized viral polypeptide include amino acid additions, substitutions, and deletions. In one embodiment, the optimized polypeptide is a Spike polypeptide, which has been further altered to include a leader/signal sequence (e.g., a Spike signal sequence or a tPA signal sequence) for maximal protein expression, a factor Xa site, a foldon trimerization domain (see, e.g., SEQ ID NO: 87), and/or linker or spacer (e.g., SEQ ID NOs: 88 or 89) sequences. An optimized polypeptide may, but need not, also include a cleavage site mutation(s) (e.g., a furin cleavage site mutation (e.g., SEQ ID NO:91)). Methods of generating an optimized viral polypeptide are described in, e.g., Fisher et al. "Polyvalent Vaccine for Optimal Coverage of Potential T-Cell Epitopes in Global HIV-1 Variants," Nat. Med. 13(1): 100-106 (2007) and International Patent Application Publication WO 2007/024941, herein incorporated by reference. Once the optimized viral polypeptide sequence is generated, the corresponding polypeptide can be produced or administered by standard techniques (e.g., recombinant viral vectors, such as the adenoviral vectors disclosed in International Patent Application Publications WO 2006/040330 and WO 2007/104792, herein incorporated by reference) and optionally assembled to form a stabilized polypeptide trimer.

The terms "optimized codon" and "codon optimized" as used herein refer to a codon sequence that has been modified to match codon frequencies in a target (e.g., a subject) or host organism, but that does not alter the amino acid sequence of the original translated protein.

By "pharmaceutically acceptable diluent, excipient, carrier, or adjuvant" is meant a diluent, excipient, carrier, or adjuvant that is physiologically acceptable to the subject while retaining the therapeutic properties of the pharmaceutical composition with which it is administered. One exemplary pharmaceutically acceptable carrier is physiological saline. Other physiologically acceptable diluents, excipients, carriers, or adjuvants and their formulations are known to one skilled in the art (see, e.g., U.S. Pub. No. 2012/0076812).

By "portion" or "fragment" is meant a part of a whole. A portion may comprise at least 10%, 20%, 30%, 40%, 50%, 60%, 70%, 80%, 90%, or 95% of the entire length of a polynucleotide or polypeptide sequence region. For polynucleotides, for example, a portion may include at least 5, 6, 7, 8, 9, 10, 20, 30, 40, 50, 60, 70, 80, 90, 100, 200, 300, 400, 500, 600, 700, 800, 900, 1000, 1100, 1200, 1300, 1400, 1500, 1600, 1700, 1800 or more contiguous nucleotides of a reference polynucleotide molecule. For polypeptides, for example, a portion may include at least 5, 6, 7, 8, 9, 10, 11, 12, 13, 14, 15, 16, 17, 18, 19, 20, 25, 50, 75, 90, 100, 125, 150, 175, 200, 225, 250, 275, 300, 325, 350, 375, 400, 425, 450, 475, 500, 525, 550, 575, or 600 or more continuous amino acids of a reference polypeptide molecule.

In some instances, a fragment of a nucleic acid molecule may include at least 20, 30, 40, 50, 60, 70, 80, 90, 100, 200, 300, 400, 500, 600, 700, 800, 900, 1000, 1100, 1200, 1300, 1400, 1500, 1600, 1700 or more consecutive nucleotides of the polynucleotide SS-Spike (SEQ ID NO: 121). In some instances, a fragment of a nucleic acid molecule may include at least 20, 30, 40, 50, 60, 70, 80, 90, 100, 200, 300, 400, 500, 600, 700, 800, 900, 1000, 1100, 1200, 1300, 1400, 1500, 1600, 1700 or more consecutive nucleotides of the polynucleotide SS-Spike-dF-PP (SEQ ID NOs: 143 and 204). In some instances, a fragment of a nucleic acid molecule may include at least 20, 30, 40, 50, 60, 70, 80, 90, 100, 200, 300, 400, 500, 600, 700, 800, 900, 1000, 1100, 1200, 1300, 1400, 1500, or more consecutive nucleotides of the polynucleotide SS-SdCT (SEQ ID NO: 122). In some instances, a fragment of a nucleic acid molecule may include at least 20, 30, 40, 50, 60, 70, 80, 90, 100, 200, 300, 400, 500, 600, 700, 800, 900, 1000, 1100, 1200, 1300, 1400, or more consecutive nucleotides of the polynucleotide SS-S.Ecto (SEQ ID NO: 123). In some instances, a fragment of a nucleic acid molecule may include at least 20, 30, 40, 50, 60, 70, 80, 90, 100, 200, 300, 400, 500, 600, 700, 800, 900, 1000, 1100, 1200, 1300, 1400, 1500, or more consecutive nucleotides of the polynucleotide SS-S1-foldon (SEQ ID NO: 129). In some instances, a fragment of a nucleic acid molecule may include at least 20, 30, 40, 50, 60, 70, 80, 90, 100, 200, 300, 400, 500, 600, 700, 800, 900, 1000, 1100, 1200, 1300, or more consecutive nucleotides of the polynucleotide SS-RBD-foldon (SEQ ID NO: 130). In some instances, a fragment of a nucleic acid molecule may include at least 20, 30, 40, 50, 60, 70, 80, 90, 100, 200, 300, 400, 500, 600, 700, 800, 900, 1000, 1100, 1200, or more consecutive nucleotides of the polynucleotide SS-S.Ecto-dF-foldon (SEQ ID NO: 136 or 193). In some instances, a fragment of a nucleic acid molecule may include at least 5, 6, 7, 8, 9, 10, 20, 30, 40, 50, 60, 70, 80, 90, 100, 200, 300, 400, 500, 600, 700, 800, 900, 1000, 1100, 1200, 1300, 1400, 1500, 1600, 1700, 1800, 1900, 2000, or more consecutive nucleotides of the polynucleotide SS-S.Ecto-PP-foldon (SEQ ID NO: 142). In some instances, a fragment of a nucleic acid molecule may include at least 5, 6, 7, 8, 9, 10, 20, 30, 40, 50, 60, 70, 80, 90, 100, 200, 300, 400, 500, 600, 700, 800, 900, 1000, 1100, 1200, 1300, 1400, 1500, 1600, 1700, 1800, 1900, 2000, or more consecutive nucleotides of the polynucleotide SS-S. Ecto-dF-PP-foldon (SEQ ID NO: 195).

In some instances, a fragment of a polypeptide may include at least 20, 25, 50, 75, 90, 100, 125, 150, 175, 200, 225, 250, 275, 300, 325, 350, 375, 400, 425, 450, 475, 500, 525, 550, or more consecutive amino acids of polypeptide SS-Spike (SEQ ID NO: 29). In some instances, a fragment of a polypeptide may include at least 20, 25, 50, 75, 90, 100, 125, 150, 175, 200, 225, 250, 275, 300, 325, 350, 375, 400, 425, 450, 475, 500, or more consecutive amino acids of polypeptide SS-SdCT (SEQ ID NO: 30). In some instances, a fragment of a polypeptide may include at least 20, 25, 50, 75, 90, 100, 125, 150, 175, 200, 225, 250, 275, 300, 325, 350, 375, 400, 425, 450, 475, 500, or more consecutive amino acids of polypeptide SS-Spike-dF-PP (SEQ ID NO: 51). In some instances, a fragment of a polypeptide may include at least 20, 25, 50, 75, 90, 100, 125, 150, 175, 200, 225, 250, 275, 300, 325, 350, 375, 400, 425, 450, 475, or more consecutive amino acids of polypeptide SS-S.Ecto (SEQ ID NO: 31). In some instances, a fragment of a polypeptide may include at least 20, 25, 50, 75, 90, 100, 125, 150, 175, 200, 225, 250, 275, 300, 325, 350, 375, 400, 425, 450, 475, or more consecutive amino acids of polypeptide SS-S1-foldon (SEQ ID NO: 37). In some instances, a fragment of a polypeptide may include at least 20, 25, 50, 75, 90, 100, 125, 150, 175, 200, 225, 250, 275, 300, 325, 350, 375, 400, 425, 450, 475, 500, or more consecutive amino acids of polypeptide SS-RBD-foldon (SEQ ID NO: 38). In some instances, a fragment of a polypeptide may include at least 20, 25, 50, 75, 90, 100, 125, 150, 175, 200, 225, 250, 275, 300, 325, 350, 375, 400, 425, or more consecutive amino acids of polypeptide SS-S.Ecto-dF-foldon (SEQ ID NO: 44). In some instances, a fragment of a polypeptide may include at least 20, 25, 50, 75, 90, 100, 125, 150, 175, 200, 225, 250, 275, 300, 325, 350, 375, 400, or more consecutive amino acids of polypeptide S.Ecto-PP-foldon (SEQ ID NO: 50). In some instances, a fragment of a polypeptide may include at least 20, 25, 50, 75, 90, 100, 125, 150, 175, 200, 225, 250, 275, 300, 325, 350, 375, 400, 425, 450, 475, 500, 525, 550, 575, 600, 625, 650, 675, or more consecutive amino acids of polypeptide SS-S.Ecto-dF-PP-foldon (SEQ ID NO: 56). In some instances, a fragment of a polypeptide may include at least 20, 25, 50, 75, 90, 100, 125, 150, 175, 200, 225, 250, 275, 300, 325, 350, 375, 400, 425, 450, 475, 500, 525, 550, 575, 600, 625, 650, 675, or more consecutive amino acids of polypeptide prM-Env with JEV Stem/TM (SEQ ID NO: 27).

In some instances, administration of a fragment of a polynucleotide (e.g., SEQ ID NOs: 93-181, 190-195, and 199-204) and/or a polypeptide (e.g., SEQ ID NOs: 1-84, e.g., SEQ ID NO: 51) to a subject may illicit an immune response in the subject.

A "promoter" is a nucleic acid sequence enabling the initiation of the transcription of a gene sequence in a messenger RNA, such transcription being initiated with the binding of an RNA polymerase on or nearby the promoter.

By "promotes an immune response" is meant eliciting a humoral response (e.g., the production of antibodies) or a cellular response (e.g., the activation of T cells, macrophages, neutrophils, and/or natural killer cells) directed against, for example, one or more infective agents (e.g., a virus (e.g., a 2019-nCoV)) or protein targets in a subject to which the pharmaceutical composition (e.g., an immunogenic composition or vaccine) has been administered.

The term "2019-nCoV-mediated disease," used interchangeably with "Coronavirus disease 2019 (COVID-19)" herein, as well as grammatical variants thereof, refers to any pathology or sequelae known in the art to be caused by (alone or in association with other mediators), exacerbated by, or associated with 2019-nCoV (SARS-CoV-2) infection or exposure in the subject having the disease. Disease can be acute (e.g., fever) or chronic (e.g., chronic fatigue), mild (e.g., hair loss) or severe (e.g., organ failure), and early-onset (e.g., 2-14 days post-infection) or late-onset (e.g., 2 weeks post-infection). Non-limiting examples of severe disease include pneumonia, acute respiratory distress syndrome (ARDS), acute respiratory failure, pulmonary edema, organ failure, or death. Non-limiting examples of symptoms include weight loss, fever, cough, difficulty breathing, fatigue, headache, loss of taste or smell, hair loss, rash, sore throat, nausea, and diarrhea. Symptoms can be mild or severe (e.g., weight loss of greater than about 5% within a week and high fever) and temporary or permanent.

A "protective level" refers to an amount or level of a marker (e.g., an antibody, a cell (e.g., an immune cell, e.g., a T cell, a B cell, an NK cell, or a neutrophil)) that is indicative of partial or complete protection from coronavirus infection or disease. An amount or level of a marker that is above the protective level indicates protection from coronavirus infection (e.g., a 2019-nCoV infection) or disease (e.g., a 2019-nCoV-mediated disease, e.g., COVID-19, e.g., severe COVID-19 disease). An amount or level of a marker that is below the protective level indicates susceptibility to coronavirus infection or disease (e.g., a 2019-nCoV-mediated disease, e.g., COVID-19, e.g., severe clinical disease). The marker may be a single measure (e.g., neutralizing antibody level) or the marker may be a combination of multiple measures (e.g., neutralizing antibody level and RBD-specific IgG2 level). In some instances, the protective level is an anti-coronavirus antibody titer of at least about 70 as measured using the pseudovirus neutralization assay described herein, an anti-coronavirus antibody titer of at least about 25 as measured using the live virus neutralization assay described herein, or an anti-coronavirus antibody titer that is above a level of at least about 80% of a median or mean level of a cohort of convalescent humans as determined by a pseudovirus neutralization assay or live virus neutralization assay as described herein. In some instances, the protective level is an anti-coronavirus antibody titer of at least about 100 as measured using the pseudovirus neutralization assay described herein.

As used herein, the term "sample" is a composition that is obtained or derived from a subject that contains a cellular and/or other molecular entity that is to be characterized and/or identified, for example based on physical, biochemical, chemical and/or physiological characteristics. A sample may be solid tissue as from a fresh, frozen, and/or preserved organ, tissue sample, biopsy, and/or aspirate; blood or any blood constituents such as plasma; bodily fluids such as cerebral spinal fluid, amniotic fluid, peritoneal fluid, or interstitial fluid. The sample may also be primary or cultured cells or cell lines. The sample may contain compounds which are not naturally intermixed with the tissue in nature such as preservatives, anticoagulants, buffers, fixatives, wax, nutrients, antibiotics, or the like.

By "sequence identity" or "sequence similarity" is meant that the identity or similarity, respectively, between two or more amino acid sequences, or two or more nucleotide sequences, is expressed in terms of the identity or similarity between the sequences. Sequence identity can be measured in terms of "percentage (%) identity," in which a higher percentage indicates greater identity shared between the sequences. Sequence similarity can be measured in terms of percentage similarity (which takes into account conservative amino acid substitutions); the higher the percentage, the more similarity shared between the sequences. Homologs or orthologs of nucleic acid or amino acid sequences possess a relatively high degree of sequence identity/similarity when aligned using standard methods. Sequence identity may be measured using sequence analysis software on the default setting (e.g., Sequence Analysis Software Package of the Genetics Computer Group, University of Wisconsin Biotechnology Center, 1710 University Avenue, Madison, Wis. 53705). Such software may match similar sequences by assigning degrees of homology to various substitutions, deletions, and other modifications. Sequence identity/similarity can be determined across all or a defined portion of the two or more sequences compared.

By "signal peptide" is meant a short peptide (e.g., 5-30 amino acids in length, such as 17 amino acids in length, e.g., SEQ ID NO: 92) at the N-terminus of a polypeptide that directs a polypeptide towards the secretory pathway (e.g., the extracellular space). The signal peptide is typically cleaved during secretion of the polypeptide. The signal sequence may direct the polypeptide to an intracellular compartment or organelle, e.g., the Golgi apparatus. A signal sequence may be identified by homology, or biological activity, to a peptide with the known function of targeting a polypeptide to a particular region of the cell. One of ordinary skill in the art can identify a signal peptide by using readily available software (e.g., Sequence Analysis Software Package of the Genetics Computer Group, University of Wisconsin Biotechnology Center, 1710 University Avenue, Madison, Wis. 53705, BLAST, or PILEUP/PRETTYBOX programs). A signal peptide can be one that is, for example, substantially identical to the amino acid sequence of SEQ ID NO: 92.

As used herein, the phrase "specifically binds" refers to a binding reaction which is determinative of the presence of an antigen in a heterogeneous population of proteins and other biological molecules that is recognized, e.g., by an antibody or antigen-binding fragment thereof, with particularity. An antibody or antigen-binding fragment thereof that specifically binds to an antigen will bind to the antigen with a $K_D$ of less than 100 nM. For example, an antibody or antigen-binding fragment thereof that specifically binds to an antigen will bind to the antigen with a $K_D$ of up to 100 nM (e.g., between 1 pM and 100 nM). An antibody or antigen-binding fragment thereof that does not exhibit specific binding to a particular antigen or epitope thereof will exhibit a $K_D$ of greater than 100 nM (e.g., greater than 500 nm, 1 pM, 100 pM, 500 pM, or 1 mM) for that particular antigen or epitope thereof. A variety of immunoassay formats may be used to select antibodies specifically immunoreactive with a particular protein or carbohydrate. For example, solid-phase ELISA immunoassays are routinely used to select antibodies specifically immunoreactive with a protein or carbohydrate. See, Harlow & Lane, Antibodies, A Laboratory Manual, Cold Spring Harbor Press, New York (1988) and Harlow & Lane, Using Antibodies, A Laboratory Manual, Cold Spring Harbor Press, New York (1999), for a description of immunoassay formats and conditions that can be used to determine specific immunoreactivity.

As used herein, the term "stabilized polypeptide trimer" or "stabilized trimer" refers, but is not limited to, an oligomer that includes a protein and/or polypeptide sequence that increases the stability (e.g., via the presence of one or more oligomerization domains) of the trimeric structure (e.g., reduces dissociation of a trimer into monomeric units). The stabilized polypeptide trimer, for example, may be a homotrimer. An "oligomerization domain" refers, but is not limited to, a polypeptide sequence that can be used to increase the stability of an oligomeric envelope protein such as, e.g., to increase the stability of a Spike trimer. Oligomerization domains can be used to increase the stability of homooligomeric polypeptides as well as heterooligomeric polypeptides. Oligomerization domains are well known in the art and include "trimerization domains." A trimerization domain refers to an oligomerization domain that stabilizes trimeric polypeptides (e.g., trimers consisting of one or more of the Spike polypeptides). Examples of trimerization domains include, but are not limited to, the T4-fibritin "foldon" trimerization domain; the coiled-coil trimerization domain derived from GCN4 (Yang et al. (2002) J. Virol. 76:4634); and the catalytic subunit of *E. coli* aspartate transcarbamoylase as a trimer tag (Chen et al. (2004) J. Virol. 78:4508).

A "subject" is a vertebrate, such as a mammal (e.g., a primate and a human, in particular a human with underlying health conditions (e.g., hypertension, diabetes, or cardiovascular disease)). Mammals also include, but are not limited to, farm animals (such as cows), sport animals (e.g., horses), pets (such as cats, and dogs), mice, rats, bats, civets, and raccoon dogs. A subject to be treated according to the methods described herein (e.g., a subject in need of protection from a 2019-nCoV infection or having a 2019-nCoV infection may be one who has been diagnosed by a medical practitioner as having such a need or infection. Diagnosis may be performed by any suitable means. A subject in whom the development of an infection is being prevented may or may not have received such a diagnosis. One skilled in the art will understand that a subject to be treated according to the present invention may have been subjected to standard tests or may have been identified, without examination, as one with a suspected infection or at high risk of infection due to the presence of one or more risk factors (e.g., exposure to a 2019-nCoV, for example, due to travel to an area where 2019-nCoV infection is prevalent). Additionally, humans with underlying health conditions (e.g., hypertension, diabetes, or cardiovascular disease) are identified as subjects at high risk of infection with a coronavirus (e.g., 2019-nCoV). The methods of treating a human subject with a composition are, therefore, particularly useful in treating, reducing, and/or preventing a 2019-nCoV infection in humans with underlying health conditions.

As used herein, the term "transfection" refers to any of a wide variety of techniques commonly used for the introduction of an exogenous nucleic acid molecule (e.g., DNA, such as an expression vector) into a prokaryotic or eukaryotic host cell, e.g., electroporation, lipofection, calcium-phosphate precipitation, DEAE-dextran transfection, and the like.

As used herein, and as well understood in the art, "treatment" is an approach for obtaining beneficial or desired results, such as clinical results. Beneficial or desired results can include, but are not limited to, alleviation or amelioration of one or more symptoms (e.g., fever, joint pain, rash, conjunctivitis, muscle pain, headache, retro-orbital pain, edema, lymphadenopathy, malaise, asthenia, sore throat, cough, nausea, vomiting, diarrhea, and hematospermia) or conditions (Zammarchi et al., *J. Clin. Virol.* 63:32-5, 2015; Waddell et al., *PLoS One* 11(5): e0156376, 2016); diminishment of the extent of disease, disorder, or condition; stabilization (e.g., not worsening) of a state of disease, disorder, or condition; prevention of spread of disease, disorder, or condition; delay or slowing the progress of the disease, disorder, or condition; amelioration or palliation of the disease, disorder, or condition; and remission (whether partial or total), whether detectable or undetectable. "Palliating" a disease, disorder, or condition means that the extent and/or undesirable clinical manifestations of the disease, disorder, or condition are lessened and/or the time course of the progression is slowed or lengthened, as compared to the extent or time course in the absence of treatment. A treatment can include one or more therapeutic agents, such as one or more of the compositions described herein and/or one or more additional therapeutic agents. Additional therapeutic agents can include agents that stimulate (e.g., interferons) or inhibit (e.g., an anti-inflammatory agent, such as corticosteroids, e.g., dexamethasone) the immune response. A treatment can include one or more therapeutic interventions, such as surgery or prone positioning.

The term "vaccine" as used herein, is defined as material used to provoke an immune response and that confers immunity for a period of time after administration of the vaccine to a subject. By "vector" is meant a DNA construct that includes one or more polynucleotides, or fragments thereof, such as from a viral species, such as a 2019-nCoV species. The vector can be used to infect cells of a subject, which results in the translation of the polynucleotides of the vector into a protein product. One type of vector is a "plasmid," which refers to a circular double stranded DNA loop into which additional DNA segments may be ligated. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "recombinant vectors"). In general, expression vectors of utility in recombinant DNA techniques are often in the form of plasmids. In the present specification, "plasmid" and "vector" may, at times, be used interchangeably as the plasmid is the most commonly used form of vector. Other vectors include, e.g., viral vectors, such as adenoviral vectors (e.g., an Ad26 vector), in particular, those described herein.

The term "virus," as used herein, is defined as an infectious agent that is unable to grow or reproduce outside a host cell and that infects mammals (e.g., humans).

A "viral vector" is defined as a recombinantly produced virus or viral; particle that comprises a polynucleotide to be delivered into a host cell. Examples of viral vectors include retroviral vectors, adenovirus vectors, adeno-associated virus vectors (e.g., see PCT publication no. WO 2006/002203), alphavirus vectors and the like.

In aspects where gene transfer is mediated by a DNA viral vector, such as an adenovirus (Ad (e.g., Ad26)) or adeno-associated virus (AAV), a vector construct refers to the polynucleotide comprising the viral genome or part thereof, and a transgene. Ads are a relatively well characterized, homogenous group of viruses, including over 50 serotypes (WO 95/27071). Ads are easy to grow and do not require integration into the host cell genome. Recombinant Ad derived vectors, particularly those that reduce the potential for recombination and generation of wild-type virus, have also been constructed (WO 95/00655 and WO 95/11984). Vectors that contain both a promoter and a cloning site into which a polynucleotide can be operatively linked are known in the art. Such vectors are capable of transcribing RNA in vitro or in vivo. To optimize expression and/or in vitro transcription, it may be necessary to remove, add or alter 5' and/or 3' untranslated portions of the clones to eliminate extra, potential inappropriate alternative translation initiation codons or other sequences that may interfere with or reduce expression, either at the level of transcription or translation.

Other features and advantages will be apparent from the following Detailed Description, the drawings, and the claims.

DETAILED DESCRIPTION OF THE INVENTION

The invention provides an isolated nucleic acid molecule comprising a nucleotide sequence that encodes a 2019-NCOV Spike (S) protein (also referred to as SARS-CoV-2 S protein herein) comprising the following modifications to the full-length amino acid sequence of SEQ ID NO: 29:
    a. stabilising mutations to proline at amino acids 986 and 987; and
    b. mutations to the furin cleavage site (SEQ ID NO: 90).

SEQ ID NO: 29 provides the amino acid sequence of the full-length 2019-NCOV Spike (S) protein; see also NCBI Reference Sequence: YP_009724390.1. The stabilising mutations are from the original amino acid in this sequence to proline. The original amino acid at position 986 is lysine (lys, K) and at position 987 is valine (val, V) as shown in SEQ ID NO: 29.

The furin cleavage site within the 2019-NCOV Spike (S) protein comprises, or has, the amino acid sequence RARR (SEQ ID NO: 90). Suitable mutations may comprise mutation to SRAG (SEQ ID NO: 225) or GGSG (SEQ ID NO: 91). The SRAG mutation is achieved by introducing a R682S and a R685G mutation into the amino acid sequence. The GGSG mutation is achieved by introducing a R682G, a R683G, a A684S and a R685G mutation into the amino acid sequence.

In some embodiments, these are the only modifications made to the sequence of SEQ ID NO: 29. Thus, a preferred nucleic acid molecule encodes a full-length 2019-NCOV Spike (S) protein with the stabilising mutations and mutations to the furin cleavage site as the only modifications. In other embodiments, the isolated nucleic acid molecule encodes a 2019-NCOV Spike (S) protein that comprises the following further modification to the full-length amino acid sequence of SEQ ID NO: 29:

c. deletion of the signal sequence.

In some embodiments, the nucleic acid encoding the 2019-NCOV Spike (S) protein is operably linked to a cytomegalovirus (CMV) promoter, preferably the CMV immediate early promoter. In some embodiments, the nucleic acid encoding the 2019-NCOV Spike (S) protein is operably linked to a cytomegalovirus (CMV) promoter comprising at least one tetracycline operator (TetO) motif. In specific embodiments, the CMV promoter comprising at least one TetO motif comprises a nucleotide sequence of SEQ ID NO: 219. In some embodiments, the CMV promotor consists of the nucleotide sequence of SEQ ID NO: 219. These nucleic acids typically form part of a vector. Vectors are described in further detail herein.

The invention also provides an isolated 2019-NCOV Spike (S) protein (also referred to as SARS-CoV-2 S protein herein) comprising the following modifications to the full-length amino acid sequence of SEQ ID NO: 29:

a. stabilising mutations to proline at amino acids 986 and 987; and
b. mutations to the furin cleavage site (SEQ ID NO: 90).

In some embodiments, these are the only modifications made to the sequence of SEQ ID NO: 29. In other embodiments the isolated 2019-NCOV Spike (S) protein comprises the following further modification to the full-length amino acid sequence of SEQ ID NO: 29:

c. deletion of the signal sequence.

The term 'recombinant' for a nucleic acid, protein and/or adenovirus, as used herein implicates that it has been modified by the hand of man, e.g. in case of an adenovector it has altered terminal ends actively cloned therein and/or it comprises a heterologous gene, i.e. it is not a naturally occurring wild type adenovirus.

Nucleotide sequences herein are provided from 5' to 3' direction, as custom in the art. The Coronavirus family contains the genera Alphacoronavirus, Betacoronavirus, Gammacoronavirus, and Deltacoronavirus. All of these genera contain pathogenic viruses that can infect a wide variety of animals, including birds, cats, dogs, cows, bats, and humans. These viruses cause a range of diseases including enteric and respiratory diseases. The host range is primarily determined by the viral spike protein (S protein), which mediates entry of the virus into host cells. Coronaviruses that can infect humans are found both in the genus Aiphacoronavirus and the genus Betacoronavirus. Known coronaviruses that cause respiratory disease in humans are members of the genus Betacoronavirus. These include SARS-CoV-1, SARS-CoV-2 and MERS, OC43 and HKU1.

As described above, SARS-CoV-2 can cause severe respiratory disease in humans. A safe and effective SARS-CoV-2 vaccine may be required to end the COVID-19 pandemic.

The SARS CoV-2 viral spike (S) protein binds to angiotensin-converting enzyme 2 (ACE2), which is the entry receptor utilized by SARS-CoV-2. ACE2 is a type I transmembrane metallocarboxypeptidase with homology to ACE, an enzyme long-known to be a key player in the Renin-Angiotensin system (RAS) and a target for the treatment of hypertension. It is expressed in, inter alia, vascular endothelial cells, the renal tubular epithelium, and in Leydig cells in the testes. PCR analysis revealed that ACE-2 is also expressed in the lung, kidney, and gastrointestinal tract, tissues shown to harbor SARS-CoV-2. The spike (S) protein of coronaviruses is a major surface protein and target for neutralizing antibodies in infected patients (Lester et al., Access Microbiology 2019; 1) and is therefore considered a potential protective antigen for vaccine design. In the research that led to the present invention, several antigen constructs based on the S protein of the SARS-CoV-2 virus were designed. It was surprisingly found that the nucleic acid of the invention (i.e. SEQ ID NO: 211) was superior in immunogenicity when expressed and that adenovectors containing this nucleic acid could be manufactured in high yields. An Ad26 vector containing a nucleic acid encoding the SARS CoV-2 S protein of SEQ ID NO: 205 induced robust neutralizing antibody responses and provided complete protection in bronchoalveolar lavage and or near-complete protection in nasal swabs following SARS-CoV-2 challenge. In addition, as shown in the Examples, it showed a robust single-shot vaccine protection against SARS-CoV-2 in nonhuman primates.

In one aspect, the present invention thus provides isolated and/or recombinant nucleic acids encoding a stabilized coronavirus S protein, in particular a SARS-CoV-2 S protein, said nucleic acids comprising a nucleotide sequence selected from the group consisting of SEQ ID NO: 211-218, or fragments thereof.

In a preferred embodiment, the present invention provides an isolated and/or recombinant nucleic acid encoding a stabilized coronavirus S protein, in particular a SARS-CoV-2 S protein, said nucleic acid comprising, or consisting of, a nucleotide sequence of SEQ ID NO: 211, or fragments thereof.

The invention also provides isolated and/or recombinant coronavirus S proteins comprising an amino acid sequence selected from the group consisting of SEQ ID NO: 205-210, or fragments thereof, as well as to nucleic acids encoding such coronavirus S proteins, or fragments thereof. In a preferred embodiment, the invention provides an isolated and/or recombinant coronavirus S protein comprising an amino acid sequence of SEQ ID NO: 205, or fragments thereof, as well as to nucleic acids encoding such coronavirus S proteins, or fragments thereof. The S protein may or may not comprise the signal peptide (or leader sequence). The signal peptide may comprise the amino acids 1-13 of SEQ ID NO: 205. In certain embodiments, the coronavirus S protein consists of an amino acid sequence of SEQ ID NO: 205. In certain embodiments, the coronavirus S protein consists of an amino acid sequence of SEQ ID NO: 205 without the signal peptide.

It is understood by a skilled person that numerous different nucleic acids can encode the same polypeptide or protein as a result of the degeneracy of the genetic code. It is also understood that skilled persons may, using routine techniques, make nucleotide substitutions that do not affect the amino acid sequence encoded by the nucleic acids, to reflect the codon usage of any particular host organism in which the polypeptides are to be expressed. Therefore, unless otherwise specified, a "nucleotide sequence encoding an amino acid sequence" includes all nucleotide sequences that are degenerate versions of each other and that encode the same amino acid sequence. Nucleotide sequences that encode proteins and RNA may include introns.

The invention thus also provides nucleic acids encoding a coronavirus S protein, in particular a SARS-CoV-2 S protein, of SEQ ID NO: 205, or a fragment thereof. In certain embodiments, the nucleic acid is codon optimized for expression in human cells.

The term "fragment" as used herein refers to a protein or (poly)peptide that has an amino-terminal and/or carboxy-terminal and/or internal deletion, but where the remaining amino acid sequence is identical to the corresponding positions in the sequence of a SARS-CoV-2 S protein, for example, the full-length sequence of a SARS-CoV-2 S protein. It will be appreciated that for inducing an immune response and in general for vaccination purposes, a protein does not need to be full length nor have all its wild type functions, and fragments of the protein (i.e. without signal peptide) are equally useful.

A fragment according to the invention is an immunologically active fragment, and typically comprises at least 15 amino acids, or at least 30 amino acids, of the SARS-CoV-2 S protein. In certain embodiments, it comprises at least 50, 75, 100, 150, 200, 250, 300, 350, 400, 450, 500, or 550 amino acids, of the SARS-CoV-2 S protein.

The person skilled in the art will also appreciate that changes can be made to a protein, e.g., by amino acid substitutions, deletions, additions, etc., e.g., using routine molecular biology procedures. Generally, conservative amino acid substitutions may be applied without loss of function or immunogenicity of a polypeptide. This can easily be checked according to routine procedures well known to the skilled person.

The present invention further provides a vector comprising a nucleic acid sequence according to the invention.

In certain embodiments of the invention, the vector is an adenovirus vector, such as a recombinant human adenoviral vector. An adenovirus according to the invention belongs to the family of the Adenoviridae, and preferably is one that belongs to the genus Mastadenovirus. It can be a human adenovirus, but also an adenovirus that infects other species, including but not limited to a bovine adenovirus (e.g., bovine adenovirus 3, BAdV3), a canine adenovirus (e.g., CAdV2), a porcine adenovirus (e.g., PAdV3 or 5), or a simian adenovirus (which includes a monkey adenovirus and an ape adenovirus, such as a chimpanzee adenovirus or a gorilla adenovirus). Preferably, the adenovirus is a human adenovirus (HAdV, or AdHu), or a simian adenovirus such as chimpanzee or gorilla adenovirus (ChAd, AdCh, or SAdV), or a rhesus monkey adenovirus (RhAd). In the invention, a human adenovirus is meant if referred to as Ad without indication of species, e.g., the brief notation "Ad26" means the same as HAdV26, which is human adenovirus serotype 26. Also as used herein, the notation "rAd" means recombinant adenovirus, e.g., "rAd26" refers to recombinant human adenovirus 26.

Most advanced studies have been performed using human adenoviruses, and human adenoviruses are preferred according to certain aspects of the invention. In certain preferred embodiments, a recombinant adenovirus according to the invention is based upon a human adenovirus. In preferred embodiments, the recombinant adenovirus is based upon a human adenovirus serotype 5, 11, 26, 34, 35, 48, 49, 50, 52, etc. According to a particularly preferred embodiment of the invention, an adenovirus is a human adenovirus of serotype 26. Advantages of these serotypes include a low seroprevalence and/or low pre-existing neutralizing antibody titers in the human population, and experience with use in human subjects in clinical trials. Simian adenoviruses generally also have a low seroprevalence and/or low pre-existing neutralizing antibody titers in the human population, and a significant amount of work has been reported using chimpanzee adenovirus vectors (e.g., U.S. Pat. No. 6,083,716; WO 2005/071093; WO 2010/086189; WO 2010/085984; Farina et al, 2001, J Virol 75: 11603-13; Cohen et al, 2002, J Gen Virol 83: 151-55; Kobinger et al, 2006, Virology 346: 394-401; Tatsis et al., 2007, Molecular Therapy 15: 608-17; see also review by Bangari and Mittal, 2006, Vaccine 24: 849-62; and review by Lasaro and Ertl, 2009, Mol Ther 17: 1333-39). Hence, in other embodiments, the recombinant adenovirus according to the invention is based upon a simian adenovirus, e.g. a chimpanzee adenovirus. In certain embodiments, the recombinant adenovirus is based upon simian adenovirus type 1, 7, 8, 21, 22, 23, 24, 25, 26, 27.1, 28.1, 29, 30, 31.1, 32, 33, 34, 35.1, 36, 37.2, 39, 40.1, 41.1, 42.1, 43, 44, 45, 46, 48, 49, 50 or SA7P. In certain embodiments, the recombinant adenovirus is based upon a chimpanzee adenovirus such as ChAdOx 1 (see, e.g., WO 2012/172277), or ChAdOx 2 (see, e.g., WO 2018/215766). In certain embodiments, the recombinant adenovirus is based upon a chimpanzee adenovirus such as BZ28 (see, e.g., WO 2019/086466). In certain embodiments, the recombinant adenovirus is based upon a gorilla adenovirus such as BLY6 (see, e.g., WO 2019/086456), or BZ1 (see, e.g., WO 2019/086466).

In a preferred embodiment of the invention, the adenoviral vectors comprise capsid proteins from rare serotypes, e.g. including Ad26. In the typical embodiment, the vector is an rAd26 virus. An "adenovirus capsid protein" refers to a protein on the capsid of an adenovirus (e.g., Ad26, Ad35, rAd48, rAd5HVR48 vectors) that is involved in determining the serotype and/or tropism of a particular adenovirus. Adenoviral capsid proteins typically include the fiber, penton and/or hexon proteins. As used herein a "capsid protein" for a particular adenovirus, such as an "Ad26 capsid protein" can be, for example, a chimeric capsid protein that includes at least a part of an Ad26 capsid protein. In certain embodiments, the capsid protein is an entire capsid protein of Ad26. In certain embodiments, the hexon, penton, and fiber are of Ad26.

One of ordinary skill in the art will recognize that elements derived from multiple serotypes can be combined in a single recombinant adenovirus vector. Thus, a chimeric adenovirus that combines desirable properties from different serotypes can be produced. Thus, in some embodiments, a chimeric adenovirus of the invention could combine the absence of pre-existing immunity of a first serotype with characteristics such as temperature stability, assembly, anchoring, production yield, redirected or improved infection, stability of the DNA in the target cell, and the like. See for example WO 2006/040330 for chimeric adenovirus Ad5HVR48, that includes an Ad5 backbone having partial capsids from Ad48, and also e.g. WO 2019/086461 for chimeric adenoviruses Ad26HVRPtr1, Ad26HVRPtr12, and Ad26HVRPtr13, that include an Ad26 virus backbone having partial capsid proteins of Ptr1, Ptr12, and Ptr13, respectively) In certain preferred embodiments the recombinant adenovirus vector useful in the invention is derived mainly or entirely from Ad26 (i.e., the vector is rAd26). In some embodiments, the adenovirus is replication deficient, e.g., because it contains a deletion in the E1 region of the genome. For adenoviruses being derived from non-group C adenovirus, such as Ad26 or Ad35, it is typical to exchange the E4-orf6 coding sequence of the adenovirus with the E4-orf6 of an adenovirus of human subgroup C such as Ad5. This allows propagation of such adenoviruses in well-known complementing cell lines that express the E1 genes of Ad5, such as for example 293 cells, PER.C6 cells, and the like (see, e.g., Havenga, et al., 2006, J Gen Virol 87: 2135-43; WO 03/104467). However, such adenoviruses will not be capable of replicating in non-complementing cells that do not express the E1 genes of Ad5.

The preparation of recombinant adenoviral vectors is well known in the art. Preparation of rAd26 vectors is described, for example, in WO 2007/104792 and in Abbink et al., (2007) Virol 81(9): 4654-63. Exemplary genome sequences of Ad26 are found in GenBank Accession EF 153474 and in SEQ ID NO: 1 of WO 2007/104792. Examples of vectors useful for the invention for instance include those described in WO2012/082918, the disclosure of which is incorporated herein by reference in its entirety.

Typically, a vector useful in the invention is produced using a nucleic acid comprising the entire recombinant adenoviral genome (e.g., a plasmid, cosmid, or baculovirus vector). Thus, the invention also provides isolated nucleic acid molecules that encode the adenoviral vectors of the invention. The nucleic acid molecules of the invention can be in the form of RNA or in the form of DNA obtained by cloning or produced synthetically. The DNA can be double-stranded or single-stranded.

The adenovirus vectors useful in the invention are typically replication deficient. In these embodiments, the virus is rendered replication deficient by deletion or inactivation of regions critical to replication of the virus, such as the E1 region. The regions can be substantially deleted or inactivated by, for example, inserting a gene of interest, such as a gene encoding a synthetic SARS CoV2 S protein (usually linked to a promoter), or a gene encoding an SARS CoV2 S antigenic polypeptide (usually linked to a promoter) within the region. In some embodiments, the vectors of the invention can contain deletions in other regions, such as the E2, E3 or E4 regions, or insertions of heterologous genes linked to a promoter within one or more of these regions. For E2- and/or E4-mutated adenoviruses, generally E2- and/or E4-complementing cell lines are used to generate recombinant adenoviruses. Mutations in the E3 region of the adenovirus need not be complemented by the cell line, since E3 is not required for replication.

In certain embodiments, the recombinant human adenovirus has a deletion in the E1 region, a deletion in the E3 region, or a deletion in both the E1 and the E3 region of the adenoviral genome. Thus, in certain embodiments, an adenoviral vector according to the invention is deficient in at least one essential gene function of the E1 region, e.g. the E1a region and/or the E1b region, of the adenoviral genome that is required for viral replication. In certain embodiments, an adenoviral vector according to the invention is deficient in at least part of the non-essential E3 region. In certain embodiments, the vector is deficient in at least one essential gene function of the E1 region and at least part of the non-essential E3 region. The adenoviral vector can be "multiply deficient," meaning that the adenoviral vector is deficient in one or more essential gene functions in each of two or more regions of the adenoviral genome. For example, the aforementioned E1-deficient or E1-, E3-deficient adenoviral vectors can be further deficient in at least one essential gene of the E4 region and/or at least one essential gene of the E2 region (e.g., the E2A region and/or E2B region).

In certain embodiments, the vector is a recombinant human adenovirus of serotype 26 (rAd26 vectors). This serotype generally has a low seroprevalence and/or low pre-existing neutralizing antibody titers in the human population. Preparation of rAd26 vectors is described, for example, in WO 2007/104792 and in Abbink et al., (2007) Virol 81(9): 4654-63. Exemplary genome sequences of Ad26 are found in GenBank Accession EF 153474 and in SEQ ID NO:1 of WO 2007/104792.

In preferred embodiments, the adenovirus is replication deficient, e.g. because it contains a deletion in the E1 region of the genome. As known to the skilled person, in case of deletions of essential regions from the adenovirus genome, the functions encoded by these regions have to be provided in trans, preferably by the producer cell, i.e. when parts or whole of E1, E2 and/or E4 regions are deleted from the adenovirus, these have to be present in the producer cell, for instance integrated in the genome thereof, or in the form of so-called helper adenovirus or helper plasmids. The adenovirus may also have a deletion in the E3 region, which is dispensable for replication, and hence such a deletion does not have to be complemented.

In a preferred embodiment, the recombinant, replication-incompetent human adenovirus type 26 (Ad26) vector is constructed to encode the SARS-CoV-2 Spike (S) protein, stabilized in its prefusion conformation. Preferably, the adenovirus comprises the nucleic acid of SEQ ID NO: 205.

A packaging cell line is typically used to produce sufficient amounts of adenovirus vectors for use in the invention. A packaging cell is a cell that comprises those genes that have been deleted or inactivated in a replication deficient vector, thus allowing the virus to replicate in the cell. Suitable packaging cell lines for adenoviruses with a deletion in the E1 region include, for example, PER.C6, 911, 293, and E1 A549.

In a preferred embodiment of the invention, the vector is an adenovirus vector, and more preferably a rAd26 vector, most preferably a rAd26 vector with at least a deletion in the E1 region of the adenoviral genome, e.g. such as that described in Abbink, J Virol, 2007. 81(9): p. 4654-63, which is incorporated herein by reference. Typically, the nucleic acid sequence encoding the synthetic SARS CoV-2 S antigens is cloned into the E1 and/or the E3 region of the adenoviral genome.

In certain embodiments, the nucleic acid encoding the coronavirus S protein is operably linked to a cytomegalovirus (CMV) promoter comprising at least one tetracycline operator (TetO) motif.

This allows for the cost-effective, large-scale manufacturing of adenoviral particles comprising the SARS CoV-2 S protein insert. Without intending to be limited by theory, it is believed that the SARS CoV-2 S protein leads to lower levels of adenoviral particle production. The addition of the TetO motif to the CMV promoter allows for higher levels of adenoviral particle production. As used herein, a "promoter" is a nucleic acid sequence enabling the initiation of the transcription of a gene sequence in a messenger RNA, such transcription being initiated with the binding of an RNA polymerase on or nearby the promoter.

As defined above, in certain embodiments, the promoter is a cytomegalovirus promoter comprising at least one tetracycline operator (TetO) motif. The TetO motif can be referred to a "regulatory sequence" or "regulatory element," which as used herein refers to a segment of nucleic acid, typically, but not limited to DNA, that modulates the transcription of the nucleic acid sequence to which it is operatively linked, and, thus, acts as a transcriptional modulator. A regulatory sequence often comprises nucleic acid sequences that are transcription binding domains that are recognized by the nucleic acid-binding domains of transcriptional proteins and/or transcription factors, enhancers, or repressors, etc. For example, it is possible to operably couple a repressor sequence to the promoter, which repressor sequence can be bound by a repressor protein that can decrease or prevent the expression of the transgene in a production cell line that expresses the repressor protein. This can improve genetic stability and/or expression levels of the nucleic acid molecule upon passaging and/or when this is produced at high quantities in the production cell line. Such systems have been described in the art. A regulatory sequence can include one or more tetracycline operator (TetO) motifs/sequences, such that expression is inhibited in the presence of the tetracycline repressor protein (TetR). In the absence of tetracycline, the TetR protein is able to bind to the TetO sites and to repress transcription of a transgene (e.g., SARS CoV-2 S antigen) operably linked to the TetO motifs/sequences. In certain embodiments, the nucleic acid encoding the SARS-CoV-2 S protein, when present in the adenoviral vector, is operably linked to a cytomegalovirus (CMV) promoter comprising at least one tetracycline operator (TetO) motif, such that the expression of the SARS CoV-2 S protein is inhibited in recombinant adenoviruses that are produced in the producer cell line in which the TetR protein is expressed. Expression will not be inhibited when the recombinant adenoviral vector is introduced into a subject or into cells that do not express the TetR protein. The invention, however, is not limited to use of a cytomegalovirus promoter comprising at least one tetracycline operator (TetO) motif.

As used herein, the term "repressor" refers to molecules (e.g., proteins) having the capability to inhibit, interfere, retard, and/or repress the production of a heterologous protein product of a recombinant expression vector (e.g., an adenoviral vector). The repressor can inhibit expression by interfering with a binding site at an appropriate location along the expression vector, such as in an expression cassette (e.g., a TetR can bind the TetO motif in the CMV promoter). Repression of vector transgene expression during vector propagation can prevent transgene instability and can increase yields of vectors having the transgene during production.

A nucleic acid is "operably linked" when it is placed into a structural or functional relationship with another nucleic acid sequence. For example, one segment of DNA can be operably linked to another segment of DNA if they are positioned relative to one another on the same contiguous DNA molecule and have a structural or functional relationship, such as a promoter or enhancer that is positioned relative to a coding sequence so as to facilitate transcription of the coding sequence; a ribosome binding site that is positioned relative to a coding sequence so as to facilitate translation; or a pre-sequence or secretory leader that is positioned relative to a coding sequence so as to facilitate expression of a pre-protein (e.g., a pre-protein that participates in the secretion of the encoded polypeptide). In other examples, the operably linked nucleic acid sequences are not contiguous, but are positioned in such a way that they have a functional relationship with each other as nucleic acids or as proteins that are expressed by them. Enhancers, for example, do not have to be contiguous. Linking may be accomplished by ligation at convenient restriction sites or by using synthetic oligonucleotide adaptors or linkers. In certain embodiments, the CMV promoter comprising at least one TetO motif comprises a nucleotide sequence of SEQ ID NO: 219, preferably the CMV promotor consists of SEQ ID NO: 219.

In a preferred embodiment, the adenoviral vector is produced in PER.C6-tetracycline repressor (TetR) cells.

The invention further provides compositions comprising a nucleic acid, a protein, and/or vector according to the invention. For administering to humans, the invention may employ pharmaceutical compositions comprising the nucleic acid, a protein, and/or vector and a pharmaceutically acceptable carrier or excipient. In the present context, the term "Pharmaceutically acceptable" means that the carrier or excipient, at the dosages and concentrations employed, will not cause any unwanted or harmful effects in the subjects to which they are administered. Such pharmaceutically acceptable carriers and excipients are well known in the art (see Remington's Pharmaceutical Sciences, 18th edition, A. R. Gennaro, Ed., Mack Publishing Company [1990]; Pharmaceutical Formulation Development of Peptides and Proteins, S. Frokjaer and L. Hovgaard, Eds., Taylor & Francis [2000]; and Handbook of Pharmaceutical Excipients, 3rd edition, A. Kibbe, Ed., Pharmaceutical Press [2000]). The purified nucleic acid, a protein, and/or vector preferably is formulated and administered as a sterile solution although it is also possible to utilize lyophilized preparations. Sterile solutions are prepared by sterile filtration or by other methods known per se in the art. The solutions are then lyophilized or filled into pharmaceutical dosage containers. The pH of the solution generally is in the range of pH 3.0 to 9.5, preferably in the range of pH 5.0 to 7.5. The nucleic acid, a protein, and/or vector typically is in a solution having a suitable pharmaceutically acceptable buffer, and the solution may also contain a salt. Optionally stabilizing agent may be present, such as albumin. In certain embodiments, detergent is added. In certain embodiments, nucleic acid, a protein, and/or vector may be formulated into an injectable preparation. These formulations contain effective amounts of nucleic acid, a protein, and/or vector, are either sterile liquid solutions, liquid suspensions or lyophilized versions and optionally contain stabilizers or excipients.

For instance, adenovirus may be stored in the buffer that is also used for the Adenovirus World Standard (Hoganson et al., Development of a stable adenoviral vector formulation, Bioprocessing March 2002, p. 43-48): 20 mM Tris pH 8, 25 mM NaCl, 2.5% glycerol. Another useful formulation buffer suitable for administration to humans is 20 mM Tris, 2 mM MgCl2, 25 mM NaCl, sucrose 10% w/v, polysorbate-80 0.02% w/v. Obviously, many other buffers can be used, and several examples of suitable formulations for the storage and for pharmaceutical administration of purified (adeno) virus preparations can for instance be found in European Patent No. 0853660, U.S. Pat. No. 6,225,289 and in international patent applications WO 99/41416, WO 99/12568, WO 00/29024, WO 01/66137, WO 03/049763, WO 03/078592, WO 03/061708.

In certain embodiments, the adenovirus composition is a sterile suspension for intramuscular injection, containing the following inactive ingredients:

Citric acid monohydrate
Trisodium citrate dihydrate
Ethanol
2-hydroxypropyl-β-cyclodextrin (HBCD)
Polysorbate 80
Sodium chloride
Sodium hydroxide
Water for injections
and optionally hydrochloric acid, and wherein the product contains no preservatives."

In a preferred embodiment, the initial shelf life of the adenoviral vector vaccine is 24 months when stored frozen at the recommended storage condition of −25° C. to −15° C. (−13° F. to 5° F.), and within these 24 months, 3 months when stored at 2° C. to 8° C. (36° F. to 46° F.),In certain embodiments, a composition according to the invention comprises a(n) (adeno) vector according to the invention in combination with a further active component. Such further active components may comprise one or more SARS-CoV-2 protein antigens, e.g., a SARS-CoV-2 protein according to the invention, or any other SARS-CoV-2 protein antigen, or additional vectors comprising nucleic acid encoding similar or alternative SARS-CoV-2 antigens. Such vectors again may be non-adenoviral or adenoviral, of which the latter can be of any serotype. In certain embodiments a composition comprising the adenovirus further comprises one or more adjuvants. Adjuvants are known in the art to further increase the immune response to an applied antigenic determinant, and pharmaceutical compositions comprising adenovirus and suitable adjuvants are for instance disclosed in WO 2007/110409, incorporated by reference herein. The terms "adjuvant" and "immune stimulant" are used interchangeably and are defined as one or more substances that cause stimulation of the immune system. In this context, an adjuvant is used to enhance an immune response to the adenovirus vectors of the invention. Examples of suitable adjuvants include aluminum salts such as aluminum hydroxide and/or aluminum phosphate; oil-emulsion compositions (or oil-in-water compositions), including squalene-water emulsions, such as MF59 (see, e.g., WO 90/14837); saponin formulations, such as for example QS21 and Immunostimulating Complexes (ISCOMS) (see, e.g., U.S. Pat. No. 5,057, 540; WO 90/03184, WO 96/11711, WO 2004/004762, WO 2005/002620); bacterial or microbial derivatives, examples of which are monophosphoryl lipid A (MPL), 3-O-deacylated MPL (3dMPL), CpG-motif containing oligonucleotides, ADP-ribosylating bacterial toxins or mutants thereof, such as *E. coli* heat labile enterotoxin LT, cholera toxin CT, and the like. It is also possible to use vector-encoded adjuvant, e.g. by using heterologous nucleic acid that encodes a fusion of the oligomerization domain of C4-binding protein (C4 bp) to the antigen of interest (e.g., Solabomi et al, 2008, Infect Immun 76: 3817-23). In certain embodiments the compositions of the invention comprise aluminum as an adjuvant, e.g., in the form of aluminum hydroxide, aluminum phosphate, aluminum potassium phosphate, or combinations thereof, in concentrations of 0.05-5 mg, e.g. from 0.075-1.0 mg, of aluminum content per dose.

In other embodiments, the compositions do not comprise adjuvants.

The present invention further provides vaccines against COVID-19 comprising a nucleic acid, a protein, and/or vector according to the invention. The term "vaccine" refers to an agent or composition containing an active component effective to induce a therapeutic degree of immunity in a subject against a certain pathogen or disease. According to the present invention, the vaccine may comprise an effective amount of a recombinant adenovirus of serotype 26 that encodes a SARS CoV-2 S protein, in particular a SARS CoV-2 protein that comprises the amino acid sequence of SEQ ID NO:1, or an antigenic fragment thereof, which results in an immune response, preferably a protective immune response, against the S protein of SARS CoV-2. The vaccine of the invention may be used in a method of preventing serious lower respiratory tract disease leading to hospitalization and the decrease the frequency of complications such as pneumonia and bronchiolitis due to SARS-CoV-2 infection and replication in a subject. The vaccine may also be used in so-called Postexposure prophylaxis (PEP), i.e. for preventing illness after potential or documented exposure to the coronavirus and/or for reducing the risk of secondary spread of infection. The "vaccine" according to the invention typically includes a pharmaceutically acceptable diluent, carrier or excipient. It may or may not comprise further active ingredients.

In certain embodiments it may be a combination vaccine that further comprises other components that induce an immune response, e.g., against other proteins of SARS-.CoV2 and/or against other infectious agents.

In certain embodiments, the vaccine is a combination vaccine comprising a vector according to the invention and a SARS CoV-2 S protein and optionally an adjuvant, wherein the vector and SARS CoV-2 protein are for concurrent administration. The SARS CoV-2 protein may be a protein as described herein or any other suitable SARS CoV-2 S protein that is known in the art. According to the invention, the vector and protein are preferably for concurrent administration (i.e. administered concurrently). "Concurrent administration or co-administration," in the context of the administration of the vector and protein to a subject, refers to the use of the vector and protein in combination, wherein said vector and protein are administered to the subject within a period of 24 hours.

In certain embodiments, the vector and protein are co-formulated, for example, with a pharmaceutically acceptable buffer, carrier, excipient and/or adjuvant, in a single composition for administration, for example admixed, and administered to a subject together at the same time. In other embodiments, the vector and protein are formulated, for example, with a pharmaceutically acceptable buffer, carrier, excipient and/or adjuvant, in separate compositions, and are administered to a subject in separate compositions within 24 hours, such as within 12 hours, 10 hours, 8 hours, 6 hours, 4 hours, 2 hours, or within 1 hour or less, e.g. in the same arm or in two different arms of the subject at about the same time.

The invention provides methods for active immunization to prevent coronavirus disease 2019 (COVID-19) caused by severe acute respiratory syndrome coronavirus 2 (SARS-CoV-2), in individuals 18 years of age and older.

The invention provides methods for active immunization to prevent coronavirus disease 2019 (COVID-19) caused by severe acute respiratory syndrome coronavirus 2 (SARS-CoV-2), in individuals 16 years of age and older.

The invention provides methods for active immunization to prevent coronavirus disease 2019 (COVID-19) caused by severe acute respiratory syndrome coronavirus 2 (SARS-CoV-2), in individuals 12 years of age and older.

The invention provides methods for active immunization to prevent coronavirus disease 2019 (COVID-19) caused by severe acute respiratory syndrome coronavirus 2 (SARS-CoV-2), in individuals 2 months of age and older.

The invention also provides methods for active immunization to prevent coronavirus disease 2019 (COVID-19) caused by severe acute respiratory syndrome coronavirus 2 (SARS-CoV-2) variants.

The SARS CoV-2 variants preferably are selected from the group consisting of the UK variant (SARS-CoV-2 lin. B.1.1.7), South Africa (SARS-CoV-2 501Y.V2) and Denmark variant (Cluster 5).

The SARS CoV-2 variants may comprise one or more mutations selected from the group consisting of del69-70, del145, A570D, D614G, P681H, T716I, S982A, D1118H, D80A, D215G, L242H, R246I, K417N, E484K, N501Y, Y435F, I1692V, M1229I and A701V.

The SARS CoV-2 variants may have the E484K mutation and one or more mutations selected from the group consisting of del69-70, del145, A570D, D614G, P681H, T716I, S982A, D1118H, D80A, D215G, L242H, R246I, K417N, E484K, N501Y, Y435F, I1692V, M1229I and A701V. Examples of such SARS CoV-2 variants are B.1.351, B.1.1.7, P.1 and CAL20C.

The invention also provides a method for inducing SARS-CoV-2 binding antibodies in a subject in need thereof, as measured, e.g., by ELISA, comprising administering to the subject a composition or vaccine as described herein.

The invention also provides a method for inducing SARS-CoV-2 neutralizing antibodies in a subject in need thereof, as measured, e.g., by VNA, comprising administering to the subject a composition or vaccine as described herein.

The invention also provides a method for inducing a SARS-CoV-2 specific T cell response in a subject in need thereof, as assessed e.g. by flow cytometry after SARS-CoV-2 S protein peptide stimulation of peripheral blood mononuclear cells (PBMCs) and intracellular staining, comprising administering to the subject a composition or vaccine as described herein.

The invention also provides a method for reducing infection and/or replication of SARS-CoV-2 or variants thereof in, e.g., the nasal tract and lungs of, a subject, comprising administering to the subject a composition or vaccine as described herein. This will reduce adverse effects resulting from SARS-CoV-2 infection in a subject, and thus contribute to protection of the subject against such adverse effects. In certain embodiments, adverse effects of SARS-COV-2 infection may be essentially prevented, i.e. reduced to such low levels that they are not clinically relevant. The recombinant adenovirus may be in the form of a vaccine according to the invention, including the embodiments described above. The administration of further active components may for instance be done by separate administration or by administering combination products of the vaccines of the invention.

The invention also provides a method for prevention of molecularly confirmed, moderate to severe/critical COVID-19, comprising administering to the subject a composition or vaccine as described herein, when given as a one or two dose vaccine. In certain embodiment, the invention provides a method for prevention of molecularly confirmed, moderate to severe/critical COVID-19 as compared to placebo, in SARS-CoV-2 seronegative adults, comprising administering to the subject a composition or vaccine as described herein when given as a one or two dose vaccine.

The invention also provides a method for prevention of molecularly confirmed, severe/critical COVID-19, comprising administering to the subject a composition or vaccine as described herein, when given as a one or two dose vaccine. In certain embodiment, the invention provides a method for prevention of molecularly confirmed, severe/critical COVID-19 as compared to placebo, in SARS-CoV-2 seronegative adults, comprising administering to the subject a composition or vaccine as described herein when given as a one or two dose vaccine.

According to the invention, moderate COVID-19 is defined as: a SARS-CoV-2 positive RT-PCR or molecular test result from any available respiratory tract sample or other sample, molecularly confirmed at central laboratory, AND at any time during the observation period until signs and symptoms disappear:

Any 1 of the following new or worsening signs or symptoms:
Respiratory rate ≥20 breaths/minute;
Abnormal saturation of oxygen (SpO2) but still >93% on room air at sea level;
Clinical or radiologic evidence of pneumonia;
Radiologic evidence of DVT;
Shortness of breath or difficulty breathing;
  OR
Any 2 of the following new or worsening signs or symptoms:
Fever (≥38.0° C. or ≥100.4° F.);
Heart rate ≥90 beats/minute;
Shaking chills or rigors;
New or changing olfactory or taste disorders;
Sore throat;
Malaise;
Headache;
Cough;
Muscle pain (myalgia);
Gastrointestinal symptoms;
Red or bruised looking feet or toes.

According to the invention, severe/critical COVID-19 is defined as: a SARS-CoV-2 positive RT-PCR or molecular test result from any available respiratory tract sample or other sample, molecularly confirmed at central laboratory; AND Clinical signs at rest indicative of severe systemic illness (respiratory rate ≥30 breaths/minute, heart rate ≥125 beats/minute, SpO2 593% on room air at sea level, or PaO2/FiO2<300 mmHg);

Respiratory failure (defined as needing high-flow oxygen, non-invasive ventilation, mechanical ventilation, or ECMO [extracorporeal membrane oxygenation])

Evidence of shock (defined as systolic blood pressure <90 mmHg, diastolic blood pressure <60 mmHg, or requiring vasopressors);

Significant acute renal, hepatic, or neurologic dysfunction;
Admission to the ICU;
Death.

In certain embodiments, severe COVID-19 is as defined by FDA guidance.

According to the invention, mild COVID-19 is defined as: A SARS-CoV-2 positive RT-PCR or molecular test result from any available respiratory tract sample or other sample, molecularly confirmed at central laboratory, AND
one of the following symptoms:
fever (≥38.0° C. or ≥100.4° F.)
sore throat,
headache,
muscle pain (myalgia),
gastrointestinal symptoms,
cough,
chest congestion,
runny nose,
wheezing,
skin rash
eye irritation or discharge,
chills,
new or changing olfactory or taste disorders,
red or bruised looking feet or toes,
shaking chills or rigors,
malaise (loss of appetite, generally unwell, fatigue, physical weakness.

A case is considered mild when it meets the above case definition but not the moderate to severe/critical definition.

Asymptomatic or undetected SARS CoV-2 infection is defined as:
participant does not fulfill the criteria for suspected COVID-19 based on signs and symptoms;
AND
has a SARS-CoV-2 positive RT-PCR or molecular test result from any available respiratory tract sample (eg, nasal swab sample, sputum sample, throat swab sample, saliva sample) or other sample;
OR
develops a positive serology (non-S protein) test (serological conversion).

The invention also provides a method for reducing SARS-CoV-2 Viral Load as Assessed by Quantitative Reverse-Transcriptase Polymerase Chain Reaction (RT-PCR) in Participants with Molecularly Confirmed, Moderate to Severe/Critical COVID-19.

The invention also provides a method for preventing or reducing the occurrence of pneumonia linked to any molecularly confirmed COVID-19 when compared to placebo.

The invention also provides a method for reducing symptoms caused by SARS CoV-2 infection. The invention also provides a method for preventing or reducing the occurrence of hospitalization linked to any molecularly confirmed COVID-19 when compared to placebo.

The invention also provides a method for preventing or reducing the occurrence of acute respiratory distress syndrome linked to any molecularly confirmed COVID-19 when compared to placebo.

The invention also provides a method for preventing or reducing the occurrence of sepsis linked to any molecularly confirmed COVID-19 when compared to placebo.

The invention also provides a method for preventing or reducing the occurrence of septic shock linked to any molecularly confirmed COVID-19 when compared to placebo.

The invention also provides a method for preventing or decreasing the mortality linked to any molecularly confirmed COVID-19.

In a preferred embodiment, the methods involve administration of the composition or vaccine as a single dose of 0.5 mL comprising $5 \times 10^{10}$ vp of the vaccine according to the invention. In certain embodiments, the effects of the vaccine (i.e. the induction of SARS-CoV-2 binding and/or neutralizing antibodies and/or the induction of a SARS-CoV-2 specific T cell response) occur already at 8 days after administration of the vaccine.

In certain embodiments the effects of the vaccine occur at least 14 days after the 1st dose of study vaccine depending on the regimen. In certain embodiments the effects of the vaccine occur at least 28 days after the 1st dose of study vaccine depending on the regimen.

In preferred embodiments, the invention provides a method for preventing molecularly confirmed moderate to severe COVID-19.

The compositions or vaccines according to the invention preferably have a vaccine efficacy of at least 50, 55, 60, 65 or 70% against molecularly confirmed moderate to severe COVID-19. Preferably, the compositions or vaccines according to the invention have a vaccine efficacy of at least 60, preferably at least 65% against molecularly confirmed moderate to severe COVID-19 with onset at least 14 days after vaccination.

According to the invention, the compositions or vaccines are effective against COVID-10 caused by SARS CoV-2, as well as to at least some of the circulating SARS-CoV-2 variants that have been associated with rapidly increasing case numbers and have particular prevalence in the UK (B1.1.7/501Y.V1), South Africa 212 (501Y.V2) and Brazil (B1.1.28/501.V3).

According to the invention it has been shown that a single dose of the vaccine was efficacious in the prevention of moderate to severe/critical COVID-19 with a vaccine efficacy (VE) of 66% both post Day 14 and post Day 28 post vaccination.

Vaccine efficacy against moderate/severe disease after Day 28 is 71% in US, 66% in Brazil and 57% in South Africa, where most of the strains (90%) were of the variant 501Y.V2 (South Africa variant). High vaccine efficacy (85% overall) was noted against severe/critical COVID-19 with over 90% efficacy in 18-59 year old. This finding was consistent across countries and regions (North and South America, South Africa), including South Africa where almost all cases were infected with the new variant of SARS-CoV-2

The onset of efficacy was estimated at day 14, with efficacy increasing through day 56, especially against severe disease consistent with the finding of neutralizing antibody titers detected from day 14 onwards, which continued to increase up to day 56 with no indication of waning up to day 85.

The compositions or vaccines according to the invention may be administered to a subject, e.g., a human subject. The total dose of the adenovirus provided to a subject during one administration is generally between $1 \times 10^7$ viral particles (vp) and $1 \times 10^{12}$ vp, preferably between $1 \times 10^8$ vp and $1 \times 10^{11}$ vp, for instance between $3 \times 10^8$ and $5 \times 10^{10}$ vp, for instance between $10^9$ and $3 \times 10^{10}$ vp.

In a preferred embodiment the vaccine of the invention is administered to a human subject at a dose of $1.25 \times 10^{10}$, $2.5 \times 10^{10}$, $5 \times 10^{10}$ or $1 \times 10^{11}$ vp per dose in a one dose or two dose regimen wherein the doses are administered about 1, 2, or 3 months apart.

In certain embodiments, the vaccine of the invention is administered to a human subject at a dose of $1 \times 10^{11}$ vp per dose in a one dose regimen followed by a second vaccination at 6, 12, or 24 months with same dose.

In a preferred embodiment, the vaccine of the invention is administered to a human subject at a dose of $5 \times 10^{10}$ vp per dose in a one dose regimen.

In another preferred embodiment, the vaccine of the invention is administered to a human subject at a dose of $1 \times 10^{11}$ vp per dose in a one dose regimen.

In another preferred embodiment, the vaccine is administered to a human subject in a two dose regimen comprising a first administration of a dose of $5 \times 10^{10}$ vp per dose and a second dose of $5 \times 10^{10}$ vp per dose administered about 2 months (8 weeks or 56 days) apart.

In certain embodiments, the vaccine is administered to a human subject at a dose of $5 \times 10^{10}$ vp per dose in a 2-dose regimen administered about 2 months (8 weeks) apart, followed by a further vaccination at 8 months, 14 months, and 26 months (that is, 6 months, 12 months, or 24 months after completion of the two dose regimen) with the same dose.

In a preferred embodiment, the composition is administered at a dose of $5 \times 10^{10}$ vp per dose in a one dose regimen.

Administration of adenovirus compositions can be performed using standard routes of administration. Non-limiting embodiments include parenteral administration, such as by injection, e.g., intramuscular, intradermal, etc., or subcutaneous, transcutaneous, or mucosal administration, e.g., intranasal, oral, and the like. However, it is particularly preferred according to the present invention to administer the vaccine intramuscularly. The advantage of intramuscular administration is that it is simple and well-established and does not carry the safety concerns for intranasal application in infants younger than 6 months. In one embodiment a composition is administered by intramuscular injection, e.g. into the deltoid muscle of the arm, or vastus lateralis muscle of the thigh.

A subject as used herein preferably is a mammal, for instance a rodent, e.g. a mouse, a cotton rat, or a non-human-primate, or a human. Preferably, the subject is a human subject. The subject can be of any age, e.g., from about 1 month to 100 years old, e.g., from about 2 months to about 80 years old, from about 6 months of age to about 3 years old, from about 3 years to about 18 years old, from about 12 years to about 18 years old, from about 18 years to about 55 years old, from about 50 years to about 75 years old, etc. In certain preferred embodiments, the subject is a human from 2 years of age. In other preferred embodiments, the human subject is a human from 18 years of age, preferably a human from 60 years of age, or a human from 65 years of age.

In certain embodiments, the composition or vaccine is administered to the subject more than once, e.g. once a year. In certain embodiments, the method of vaccination consists of a single administration of the composition or vaccine to the subject. It is also possible to provide one or more second (or booster) administrations of the vaccine of the invention. If a second vaccination is performed, typically, such a second vaccination will be administered to the same subject at a moment between one week and one year, preferably between two weeks and four months, after administering the composition to the subject for the first time (which is in such cases sometimes referred to as 'priming vaccination')

The invention further provides isolated host cells comprising a recombinant human adenovirus of serotype 26 comprising nucleic acid encoding a SARS-CoV-2 S protein or fragment thereof. A host cell (sometimes also referred to in the art and herein as 'packaging cell' or 'complementing cell' or 'producer cell') that can be used can be any host cell wherein a desired adenovirus can be propagated. A host cell line is typically used to produce sufficient amounts of adenovirus vectors of the invention. A host cell is a cell that comprises those genes that have been deleted or inactivated in a replication-defective vector, thus allowing the virus to replicate in the cell. Suitable cell lines include, for example, PER.C6, 911, 293, and E1 A549. In certain embodiments, the host cell further comprises a nucleotide sequence encoding a tetracycline repressor (TetR) protein. The nucleotide sequence encoding the TetR protein can, for example, be integrated in the genome of the host cell. By way of an example, the nucleotide sequence encoding the TetR protein can be integrated in chromosome 1. The host cell line can, for example, be a PER.C6 cell.

In a preferred embodiment, the host cell is a PER.C6 cell comprising a nucleotide sequence encoding a tetracycline repressor (TetR) protein. Such "PER.C6 TetR" cells are PER.C6 cells (human retina cells immortalized by E1) to which a nucleotide encoding TetR has been introduced, as described in PCT/EP2018/053201 (incorporated herein by reference). In such embodiments, preferably the adenovirus comprises a nucleic acid encoding a SARS-CoV-2 S protein or fragment thereof which is operably linked to a promoter comprising one or more Tet operator (TetO) motifs. In preferred embodiments, the promoter is a CMV promoter comprising one or more TetO motifs. Preferably the promoter is a CMV promoter comprising two TetO motifs. Preferably the promoter is the CMV promoter and comprises a nucleotide sequence of SEQ ID NO: 219. In some embodiments, the promotor consists of the nucleotide sequence of SEQ ID NO: 219.

The invention further provides methods for making a vaccine against SARS Coronavirus virus (SARS-COV-2), comprising providing a recombinant human adenovirus of serotype 26 that comprises nucleic acid encoding a SARS-COV-2 S protein or fragment thereof as described herein, propagating said recombinant adenovirus in a culture of host cells, isolating and purifying the recombinant adenovirus, and bringing the recombinant adenovirus in a pharmaceutically acceptable composition. In certain embodiments, provided herein are methods of producing an adenoviral particle comprising a SARS-CoV-2 antigen. The methods comprise (a) contacting a host cell of the invention with an adenoviral vector of the invention and (b) growing the host cell under conditions wherein the adenoviral particle comprising the SARS-CoV-2 antigen is produced. Recombinant adenovirus can be prepared and propagated in host cells, according to well-known methods, which entail cell culture of the host cells that are infected with the adenovirus. The cell culture can be any type of cell culture, including adherent cell culture, e.g. cells attached to the surface of a culture vessel or to microcarriers, as well as suspension culture.

Most large-scale suspension cultures are operated as batch or fed-batch processes because they are the most straightforward to operate and scale up. Nowadays, continuous processes based on perfusion principles are becoming more common and are also suitable (see, e.g., WO 2010/060719, and WO 2011/098592, both incorporated by reference herein, which describe suitable methods for obtaining and purifying large amounts of recombinant adenoviruses).

The invention further provides an isolated recombinant nucleic acid that forms the genome of a recombinant human adenovirus of serotype 26 that comprises nucleic acid encoding a SARS-CoV2 S protein or fragment thereof.

Wuhan coronavirus (2019-nCoV) polypeptides can be used to elicit protective and therapeutic immune responses (e.g., humoral responses or cellular responses) against a coronavirus infection (e.g., 2019-nCoV infection) when administered to a subject (e.g., a human subject) infected with or exposed to a coronavirus (e.g., 2019-nCoV). The compositions that can be prepared for administration to a subject include a 2019-nCoV protein (e.g., Spike (S) protein or a portion thereof (e.g., a polypeptide with the sequence of any one of SEQ ID NOs: 1-84, e.g., SEQ ID NO: 51, or a polypeptide with at least 85% (e.g., at least 90%, 95%, 99%, or more) sequence identity to a polypeptide with the sequence of any one of SEQ ID NOs: 1-84)) or a vector (e.g., an expression vector, such as a plasmid, or a viral vector, such as an adenovirus (e.g., Ad26), poxvirus, adeno-associated virus, retroviral, or other viral vector, or naked or encapsulated DNA) containing a nucleic acid sequence that encodes the 2019-nCoV protein (e.g., a nucleic acid molecule with the sequence of any one of SEQ ID NOs: 93-181, 190-195, and 199-204; or a nucleic acid molecule with at least 85% (e.g., at least 90%, 95%, 99%, or more) sequence identity to a nucleic acid molecule with the sequence of any one of SEQ ID NOs: 93-181, 190-195, and 199-204).

The generation of DNA vaccines expressing a 2019-nCoV Spike (S) protein are described. The 2019-nCoV DNA vaccines can be generated by incorporating a polynucleotide (e.g., SEQ ID NOs: 93-181, 190-195, and 199-204 or a variant thereof with up to 85% or more sequence identity thereto) encoding S or a portion thereof (e.g., SEQ ID NOs: 1-84, e.g., SEQ ID NO: 51, or a variant thereof with up to 85% or more sequence identity thereto) into a mammalian expression vector (e.g., pcDNA3.1+; Invitrogen, CA, USA) to generate a vaccine. Generation of recombinant viral vectors (e.g., Ad26 viral vectors) expressing 2019-nCoV Spike (S) protein is also described. 2019-nCoV viral vectors can be generated by incorporating a polynucleotide (e.g., SEQ ID NOs: 93-181, 190-195, and 199-204 or a variant thereof with up to 85% or more sequence identity thereto) encoding S or a portion thereof (e.g., SEQ ID NOs: 1-84, or a variant thereof with up to 85% or more sequence identity thereto, e.g., SEQ ID NO: 51) into a viral vector (e.g., an Ad26 viral vector).

Anti-coronavirus antibodies (e.g., anti-2019-nCoV antibodies, e.g., anti-Spike antibodies, e.g., anti-Spike neutralizing antibodies) present in a sample from a subject (e.g., a human subject) can be used to detect and/or monitor a protective antibody response. The anti-coronavirus antibodies (e.g., anti-Spike antibodies, e.g., anti-Spike neutralizing antibodies) may be measured in a short timeframe (e.g., between 1 day post-administration and 8-weeks post-administration) or a longer timeframe (e.g., between 2 month post-administration and 15 years post-administration) after administration of a therapeutic composition (e.g., any of the compositions or immunogenic compositions described herein).

The nucleic acid molecules, polypeptides, vectors, vaccines, compositions, antibodies, and methods treating and preventing a 2019-nCoV infection are described herein.

I. COMPOSITIONS AND METHODS

Nucleic Acid Molecules

The nucleic acid molecules (e.g., SEQ ID NOs: 93-181, 190-195, and 199-204 or a variant thereof with up to 85% or more sequence identity thereto) were designed based on the Wuhan coronavirus (2019-nCoV). The nucleic acid molecules encode regions of the 2019-nCoV Spike (S) protein, for example, the full-length (SEQ ID NO: 121), Spike with a deletion of the cytoplasmic region (SEQ ID NO: 94), the ectodomain (SEQ ID NO: 95), S1 (SEQ ID NO: 96), and the receptor binding domain (SEQ ID NO: 97). The invention also features additional modifications to the abovementioned regions of S, including deletion of or inclusion of signal sequences (e.g., SEQ ID NO: 189), stabilizing mutations (e.g., proline substitutions corresponding to amino acids K969 and V970 of SEQ ID NO: 1), mutations to a furin cleavage site (e.g., SEQ ID NO: 188), introduction of a trimerization domain (e.g., a foldon trimerization domain, e.g., SEQ ID NO: 184), introduction of linker or spacer sequences (e.g., SEQ ID NOs: 185 and 186), and combinations thereof. The nucleic acid molecules have been optimized relative to the wild-type 2019-nCoV Spike nucleotide sequence for improved expression in host cells (e.g., mammalian (e.g., human) host cells). Optimization can include the addition of a leader sequence, restriction site, and/or a Kozak sequence.

The nucleic acid molecules have a nucleotide sequence with at least 85% (e.g., at least 86%, 87%, 88%, 89%, 90%, 91%, 92%, 93%, 94%, 95%, 96%, 97%, 98%, 99% or 100%) sequence identity to, all or a portion of any one of SEQ ID NOs: 93-181, 190-195, and 199-204, or a complementary sequence thereof. For example, a nucleic acid molecule can have the nucleotide sequence of SEQ ID NO: 195. Alternatively, an isolated nucleic acid molecule has a nucleotide sequence that encodes a 2019-nCoV polypeptide with at least 85% (e.g., at least 86%, 87%, 88%, 89%, 90%, 91%, 92%, 93%, 94%, 95%, 96%, 97%, 98%, 99% or 100%) sequence identity to an amino acid sequence of any one of SEQ ID NOs: 1-84. For example, an isolated nucleic acid molecule can have a nucleotide sequence encoding a polypeptide having the amino acid sequence of SEQ ID NO: 56.

The nucleic acid molecules may be further optimized, such as by codon optimization, for expression in a targeted mammalian subject (e.g., human or a non-human animal for vaccine production).

The nucleic acid molecules may also be inserted into expression vectors, such as a plasmid, or a viral vector, such as an adenovirus, poxvirus, adeno-associated virus, retroviral, or other viral vector, or prepared as naked or encapsulated DNA and incorporated into compositions.

Polypeptides

The polypeptides are coronavirus polypeptides (e.g., 2019-nCoV polypeptides) corresponding to, for example, regions of the 2019-nCoV Spike (S) protein (SEQ ID NOs: 1-84), for example, the full-length (SEQ ID NO: 29), Spike with a deletion of the cytoplasmic region (SEQ ID NO: 2), the ectodomain (SEQ ID NO: 3), S1 (SEQ ID NO: 4), the receptor binding domain (SEQ ID NO: 5) and variants having at least 85% (e.g., at least 86%, 87%, 88%, 89%, 90%, 91%, 92%, 93%, 94%, 95%, 96%, 97%, 98%, 99% or 100%) sequence identity to, all or a portion of any one of SEQ ID NOs: 1-84. The polypeptides may include at least 5, 6, 7, 8, 9, 10, 20, 30, 40, 50, 60, 70, 80, 90, 100, 200, 300, 400, 500, 600, 700, 800, 900, 1000, 1100, 1200, 1300, 1400, 1500, 1600, 1700, or 1800 or more continuous or non-continuous amino acids of any one of SEQ ID NOs: 1-84. Polypeptides may also include a deletion of or an inclusion of a signal sequence (e.g., SEQ ID NO: 92), stabilizing mutations (e.g., proline substitutions corresponding to amino acids K969 and V970 of SEQ ID NO: 1), mutations to a furin cleavage site (e.g., SEQ ID NO: 91), introduction of a trimerization domain (e.g., a foldon trimerization domain, e.g., SEQ ID NO: 87), introduction of linker or spacer sequences (e.g., SEQ ID NOs: 88 and 89), and combinations thereof. For example, a polypeptide can have the amino acid sequence of SEQ ID NO: 28. The polypeptides may also be isolated from other components (e.g., components with which the polypeptides are natively associated) and incorporated into compositions.

Vectors

The invention also features recombinant vectors (e.g., an Ad26 viral vector) including any one or more of the polynucleotides described above. The vectors can be used to deliver a nucleic acid expressing an immunogen (e.g., one of more of SEQ ID NOs: 1-84 or variants thereof, having at least 85-99% sequence identity thereto, for example at least greater than 90% sequence identity thereto), and include mammalian, viral, and bacterial expression vectors. For example, a vector can be used to deliver a nucleic acid (e.g., a nucleic acid containing the nucleotide sequence of SEQ ID NOs: 104 or 204) expressing an immunogen with the amino acid sequence of SEQ ID NO: 51. For example, a vector can be used to deliver a nucleic acid (e.g., a nucleic acid containing the nucleotide sequence of SEQ ID NO: 195) expressing an immunogen with the amino acid sequence of SEQ ID NO: 56. The mammalian, viral, and bacterial vectors can be genetically modified to contain one or more nucleic acid sequences set forth in SEQ ID NOs: 93-181, 190-195, and 199-204 or variants thereof, having at least 85-99% sequence identity thereto, for example at least greater than 90% sequence identity thereto, and complements thereof.

The vectors may be, for example, plasmids, artificial chromosomes (e.g. BAG, PAC, YAC), and virus or phage vectors, and may optionally include a promoter, enhancer, or regulator for the expression of the polynucleotide. The vectors may also contain one or more selectable marker genes, for example an ampicillin, neomycin, and/or kanamycin resistance gene in the case of a bacterial plasmid or a resistance gene for a fungal vector. Vectors may be used in vitro, for example, to produce DNA or RNA or used to transfect or transform a host cell, for example, a mammalian host cell, e.g., for the production of protein encoded by the vector. The vectors may also be adapted to be used in vivo, for example in a method of DNA vaccination, RNA vaccination, or gene therapy.

Promoters and other expression regulation signals may be selected to be compatible with the host cell for which expression is designed. For example, mammalian promoters include the metallothionein promoter, which can be induced in response to heavy metals, such as cadmium, and the β-actin promoter. A viral promoter, which can be obtained from the genome of a virus, such as, for example, polyoma virus, fowlpox virus, adenovirus (A), bovine papilloma virus, avian sarcoma virus, cytomegalovirus (CMV), a retrovirus, hepatitis-B virus, and Simian Virus 40 (SV40), and human papillomavirus (HPV), may also be used. These promoters are well known and readily available in the art.

A preferred promoter element is the CMV immediate early promoter. In some embodiments, the expression plasmid is pcDNA3.1+(Invitrogen, CA, USA). In some embodiments, the expression vector is a viral vector, such as a vector derived from adenovirus or poxvirus. Viral genomes provide a rich source of vectors that can be used for the efficient delivery of exogenous genes into the genome of a cell (e.g., a eukaryotic or prokaryotic cell). Viral genomes are particularly useful vectors for gene delivery because the polynucleotides contained within such genomes are typically incorporated into the genome of a target cell by generalized or specialized transduction. These processes occur as part of the natural viral replication cycle, and do not require added proteins or reagents to induce gene integration. Examples of viral vectors that can be used to deliver a nucleic acid expressing an immunogen (e.g., one of more of SEQ ID NOs: 1-84 or variants thereof having at least 85-99% sequence identity thereto, for example at least greater than 90% sequence identity thereto) include a retrovirus, adenovirus (e.g., Ad2, Ad5, Ad11, Ad12, Ad24, Ad26, Ad34, Ad35, Ad40, Ad48, Ad49, Ad50, Ad52 (e.g., a RhAd52), Ad59 (e.g., a RhAd59), and Pan9 (also known as AdC68)), parvovirus (e.g., adeno-associated viruses), coronavirus, negative strand RNA viruses such as orthomyxovirus (e.g., influenza virus), rhabdovirus (e.g., rabies and vesicular stomatitis virus), paramyxovirus (e.g. measles and Sendai), positive strand RNA viruses, such as picornavirus and alphavirus, and double stranded DNA viruses including adenovirus, herpesvirus (e.g., Herpes Simplex virus types 1 and 2, Epstein-Barr virus, cytomegalovirus), and poxvirus (e.g., vaccinia, modified vaccinia Ankara (MVA), fowlpox and canarypox). Other viruses useful for delivering polynucleotides encoding immunogens (e.g., polypeptides) include Norwalk virus, togavirus, coronavirus, reoviruses, papovavirus, hepadnavirus, and hepatitis virus, for example. Examples of retroviruses include: avian leukosis-sarcoma, mammalian C-type, B-type viruses, D-type viruses, HTLV-BLV group, lentivirus, spumavirus (Coffin, J. M., Retroviridae: The viruses and their replication, *In Fundamental Virology*, Third Edition, B. N. Fields, et al., Eds., Lippincott-Raven Publishers, Philadelphia, 1996). For example, the vector can be Ad26. These adenovirus vectors can be derived from, for example, human, chimpanzee, or rhesus adenoviruses. Other examples include murine leukemia viruses, murine sarcoma viruses, mouse mammary tumor virus, bovine leukemia virus, feline leukemia virus, feline sarcoma virus, avian leukemia virus, human T-cell leukemia virus, baboon endogenous virus, Gibbon ape leukemia virus, Mason Pfizer monkey virus, simian immunodeficiency virus, simian sarcoma virus, Rous sarcoma virus and lentiviruses. Other examples of vectors are described, for example, in McVey et al., (U.S. Pat. No. 5,801,030); incorporated herein in its entirety by reference. The nucleic acid material (e.g., including a nucleic acid molecule) of the viral vector may be encapsulated, e.g., in a lipid membrane or by structural proteins (e.g., capsid proteins), that may include one or more viral polypeptides (e.g., a glycoprotein). The viral vector can be used to infect cells of a subject, which, in turn, promotes the translation of the heterologous gene(s) of the viral vector into the immunogens. For example, a viral vector can be genetically modified to contain one or more nucleic acid sequences set forth in SEQ ID NOs: 93-181, 190-195, and 199-204 or variants thereof having at least 85-99% sequence identity thereto, for example at least greater than 90% sequence identity thereto, and complements thereof. Adenoviral vectors disclosed in International Patent Application Publications WO 2006/040330 and WO 2007/104792, each incorporated by reference herein, are particularly useful as vectors. These adenoviral vectors can encode and/or deliver one or more of the immunogens (e.g., 2019-nCoV polypeptides) to treat a subject having a pathological condition associated with a viral infection (e.g., a 2019-nCoV infection). In some embodiments, one or more recombinant adenovirus vectors can be administered to the subject in order to express more than one type of immunogen (e.g., 2019-nCoV polypeptide). In some embodiments, a recombinant adenovirus vector can be modified to change the hexon HVR domains (e.g., replace one or more HVRs with those of a different serotype). Besides adenoviral vectors, other viral vectors and techniques are known in the art that can be used to facilitate delivery and/or expression of one or more of the immunogens in a subject (e.g., a human). These viruses include poxviruses (e.g., vaccinia virus and modified vaccinia virus Ankara (MVA); see, e.g., U.S. Pat. Nos. 4,603,112 and 5,762,938, each incorporated by reference herein), herpesviruses, togaviruses (e.g., Venezuelan Equine Encephalitis virus; see, e.g., U.S. Pat. No. 5,643,576, incorporated by reference herein), picornaviruses (e.g., poliovirus; see, e.g., U.S. Pat. No. 5,639,649, incorporated by reference herein), baculoviruses, and others described by Wattanapitayakul and Bauer (*Biomed. Pharmacother.* 54:487 (2000), incorporated by reference herein).

Gene transfer techniques using these viruses are known to those skilled in the art. Retrovirus vectors for example may be used to stably integrate the polynucleotide into the host genome, although such recombination is not preferred. Replication-defective adenovirus vectors by contrast remain episomal and therefore allow transient expression.

Vectors capable of driving expression in insect cells (for example baculovirus vectors), in human cells, in yeast or in bacteria may be employed in order to produce quantities of the 2019-nCoV protein encoded by the polynucleotides of the present invention, for example, for use as subunit vaccines or in immunoassays.

Antibodies

Anti-2019-nCoV antibodies are capable of specifically binding to a 2019-nCoV polypeptide and are capable of inhibiting a 2019-nCoV-mediated activity (e.g., viral spread, infection, and or cell fusion) in a subject (e.g., a human). The result of such binding may be, for example, a reduction in viral titer (e.g., viral load), by about 1% (e.g., 2%, 3%, 4%, 5%, 6%, 7%, 8%, 9%, 10%, 20%, 30%, 40%, 50%, 60%, 70%, 80%, or 90%) or more, after administration of an antibody to a subject infected with 2019-nCoV. The anti-2019-nCoV antibodies may selectively bind to an epitope comprising all, or a portion of, the Env region of the 2019-nCoV polyprotein. In particular, the anti-2019-nCoV antibodies may selectively bind to an epitope comprising all, or a portion of, any one of SEQ ID NOs: 1-84. For Example, antibodies may bind to an epitope comprising all, or a portion of, SEQ ID NO: 28. The antibodies can therefore be used to prevent or treat a 2019-nCoV infection.

The specific binding of an antibody or antibody fragment to a 2019-nCoV polyprotein can be determined by any of a variety of established methods. The affinity can be represented quantitatively by various measurements, including the concentration of antibody needed to achieve half-maximal inhibition of viral spread (e.g., viral titer) in vitro ($IC_{50}$) and the equilibrium constant ($K_D$) of the antibody-2019-nCoV polyprotein complex dissociation. The equilibrium constant, $K_D$, that describes the interaction of 2019-nCoV polyprotein with an antibody is the chemical equilibrium constant for the dissociation reaction of a 2019-nCoV polyprotein-antibody complex into solvent-separated 2019-nCoV polyprotein and antibody molecules that do not interact with one another.

Antibodies are those that specifically bind to a 2019-nCoV polyprotein (e.g., the Env region of 2019-nCoV) with a $K_D$ value of less than 1 pM (e.g., 900 nM, 800 nM, 700 nM, 600 nM, 500 nM, 400 nM, 300 nM, 200 nM, 100 nM, 95 nM, 90 nM, 85 nM, 80 nM, 75 nM, 70 nM, 65 nM, 60 nM, 55 nM, 50 nM, 45 nM, 40 nM, 35 nM, 30 nM, 25 nM, 20 nM, 15 nM, 10 nM, 5 nM, 4 nM, 3 nM, 2 nM, or 1 nM). In certain cases, antibodies are those that specifically bind to a 2019-nCoV polyprotein with a $K_D$ value of less than 1 nM (e.g., 990 pM, 980 pM, 970 pM, 960 pM, 950 pM, 940 pM, 930 pM, 920 pM, 910 pM, 900 pM, 890 pM, 880 pM, 870 pM, 860 pM, 850 pM, 840 pM, 830 pM, 820 pM, 810 pM, 800 pM, 790 pM, 780 pM, 770 pM, 760 pM, 750 pM, 740 pM, 730 pM, 720 pM, 710 pM, 700 pM, 690 pM, 680 pM, 670 pM, 660 pM, 650 pM, 640 pM, 630 pM, 620 pM, 610 pM, 600 pM, 590 pM, 580 pM, 570 pM, 560 pM, 550 pM, 540 pM, 530 pM, 520 pM, 510 pM, 500 pM, 490 pM, 480 pM, 470 pM, 460 pM, 450 pM, 440 pM, 430 pM, 420 pM, 410 pM, 400 pM, 390 pM, 380 pM, 370 pM, 360 pM, 350 pM, 340 pM, 330 pM, 320 pM, 310 pM, 300 pM, 290 pM, 280 pM, 270 pM, 260 pM, 250 pM, 240 pM, 230 pM, 220 pM, 210 pM, 200 pM, 190 pM, 180 pM, 170 pM, 160 pM, 150 pM, 140 pM, 130 pM, 120 pM, 110 pM, 100 pM, 90 pM, 80 pM, 70 pM, 60 pM, 50 pM, 40 pM, 30 pM, 20 pM, 10 pM, 5 pM, or 1 pM).

Antibodies can also be characterized by a variety of in vitro binding assays. Examples of experiments that can be used to determine the $K_D$ or $IC_{50}$ of a 2019-nCoV antibody include, e.g., surface plasmon resonance, isothermal titration calorimetry, fluorescence anisotropy, and ELISA-based assays, among others. ELISA represents a particularly useful method for analyzing antibody activity, as such assays typically require minimal concentrations of antibodies. A common signal that is analyzed in a typical ELISA assay is luminescence, which is typically the result of the activity of a peroxidase conjugated to a secondary antibody that specifically binds a primary antibody (e.g., a 2019-nCoV antibody). Antibodies are capable of binding 2019-nCoV and epitopes derived thereof, such as epitopes containing one or more of residues of any one of SEQ ID NOs: 1-84, as well as isolated peptides derived from 2019-nCoV that structurally pre-organize various residues in a manner that may simulate the conformation of these amino acids in the native protein. For instance, antibodies may bind peptides containing the amino acid sequence of any one of SEQ ID NOs: 1-84, or a peptide containing between about 10 and about 30 continuous or discontinuous amino acids of any one of SEQ ID NOs: 1-84. In a direct ELISA experiment, this binding can be quantified, e.g., by analyzing the luminescence that occurs upon incubation of an HRP substrate (e.g., 2,2'-azino-di-3-ethylbenzthiazoline sulfonate) with an antigen-antibody complex bound to an HRP-conjugated secondary antibody.

Antibodies include those that are generated by immunizing a host (e.g., a mammalian host, such as a human) with the polypeptides of SEQ ID NOs: SEQ ID NOs: 1-84. The antibodies can be prepared recombinantly and, if necessary, humanized, for subsequent administration to a human recipient if the host in which the anti-2019-nCoV antibodies are generated is not a human.

Compositions

Compositions include DNA or RNA vectors containing a heterologous nucleic acid molecule encoding an antigenic or therapeutic gene product, or fragment thereof, from a 2019-nCoV (e.g., all or a portion of the nucleic acid molecule of any one of SEQ ID NOs: 93-181, 190-195, and 199-204, or a variant thereof having at least 85% (e.g., 86%, 87%, 88%, 89%, 90%, 91%, 92%, 93%, 94%, 95%, 96%, 97%, 98%, 99% or 100%) sequence identity to any one of SEQ ID NOs: 93-181, 190-195, and 199-204, and complements thereof). For example, a composition can contain a DNA vector containing the nucleic acid molecule of SEQ ID NO: 143 or SEQ ID NO: 204. For example, a composition can contain a DNA vector containing the nucleic acid molecule of SEQ ID NO: 195. Additional compositions include an immunogenic polypeptide, or fragment thereof, from a 2019-nCoV polyprotein (e.g., all or a portion of the polypeptide of SEQ ID NO: 1-84, or a variant thereof having at least 85% (e.g., 86%, 87%, 88%, 89%, 90%, 91%, 92%, 93%, 94%, 95%, 96%, 97%, 98%, 99% or 100%) sequence identity to SEQ ID NOs: 1-84). For example, a composition can include an immunogenic polypeptide with the amino acid sequence of SEQ ID NO: 51. For example, a composition can include an immunogenic polypeptide with the amino acid sequence of SEQ ID NO: 28. The compositions may also include a 2019-nCoV antibody (e.g., an anti-Spike antibody) capable of binding 2019-nCoV and epitopes derived thereof, such as epitopes containing one or more of residues of any one of SEQ ID NOs: 1-84. For example, a composition can include an antibody capable of binding epitopes containing one or more of residues of SEQ ID NO: 28. The antibody may be generated by immunization of a host with a polypeptide of any one of SEQ ID NOs: 1-84. For example, an antibody may be generated by immunization of a host with a polypeptide having the amino acid sequence of SEQ ID NO: 28.

Optionally, the compositions can be formulated, for example, for administration via a viral vector (e.g., an adenovirus vector or a poxvirus vector). Recombinant adenoviruses offer several significant advantages for use as vectors for the expression of, for example, one or more of the immunogens (e.g., 2019-nCoV polypeptides). The viruses can be prepared to high titer, can infect non-replicating cells, and can confer high-efficiency transduction of target cells ex vivo following contact with a target cell population. Furthermore, adenoviruses do not integrate their DNA into the host genome. Thus, their use as expression vectors has a reduced risk of inducing spontaneous proliferative disorders. In animal models, adenoviral vectors have generally been found to mediate high-level expression for approximately one week. The duration of transgene expression (expression of a nucleic acid molecule) can be prolonged by using cell or tissue-specific promoters. Other improvements in the molecular engineering of the adenovirus vector itself have produced more sustained transgene expression and less inflammation. This is seen with so-called "second generation" vectors harboring specific mutations in additional early adenoviral genes and "gutless" vectors in which virtually all the viral genes are deleted utilizing a Cre-Lox strategy (Engelhardt et al., *Proc. Natl. Acad. Sci. USA* 91:6196 (1994) and Kochanek et al., *Proc. Natl. Acad. Sci. USA* 93:5731 (1996), each herein incorporated by reference).

Therapeutic formulations of the compositions are prepared for administration to a subject (e.g., a human) using standard methods known in the art by mixing the active ingredient having the desired degree of purity with optional physiologically acceptable carriers, excipients or stabilizers (Remington's Pharmaceutical Sciences (20$^{th}$ edition), ed. A. Gennaro, 2000, Lippincott, Williams & Wilkins, Philadelphia, Pa.). Therapeutic formulations of the compositions are prepared using standard methods known in the art by mixing the active ingredient having the desired degree of purity with optional physiologically acceptable carriers, excipients or stabilizers (Remington's Pharmaceutical Sciences (20$^{th}$ edition), ed. A. Gennaro, 2000, Lippincott, Williams & Wilkins, Philadelphia, Pa.). Acceptable carriers, include saline, or buffers such as phosphate, citrate and other organic acids; antioxidants including ascorbic acid; low molecular weight (less than about 10 residues) polypeptides; proteins, such as serum albumin, gelatin or immunoglobulins; hydrophilic polymers such as polyvinylpyrrolidone, amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, PLURONICS™, or PEG.

Optionally, but preferably, the formulation contains a pharmaceutically acceptable salt, preferably sodium chloride, and preferably at about physiological concentrations. Optionally, the formulations can contain a pharmaceutically acceptable preservative. The preservative concentration may range from about 0.1 to about 2.0%, typically v/v. Suitable preservatives include those known in the pharmaceutical arts, such as benzyl alcohol, phenol, m-cresol, methylparaben, and propylparaben. Optionally, the formulations can include a pharmaceutically acceptable surfactant at a concentration of about 0.005 to about 0.02%.

Optionally, the compositions may be formulated to include for co-administration, or sequential administration with, an adjuvant and/or an immunostimulatory agent, (e.g., a protein), such as receptor molecules, nucleic acids, immunogenic proteins, pharmaceuticals, chemotherapy agents, and accessory cytokines. For example, interleukin-3 (IL-3), interleukin-4 (IL-4), interleukin-5 (IL-5), interleukin-7 (IL-7), interleukin-8 (1-8), interleukin-10 (IL-10), interleukin-11 (IL-11), interleukin-12 (IL-12), interleukin-13 (IL-13), lipid A, phospholipase A2, endotoxins, staphylococcal enterotoxin B, Type I interferon, Type II interferon, transforming growth factor-β (TGF-β), lymphotoxin migration inhibition factor, granulocyte-macrophage colony-stimulating factor (CSF), monocyte-macrophage CSF, granulocyte CSF, vascular epithelial growth factor (VEGF), angiogenin, transforming growth factor (TGF-α), heat shock proteins (HSPs), carbohydrate moieties of blood groups, Rh factors, fibroblast growth factors, nucleotides, DNA, RNA, mRNA, MART, MAGE, BAGE, mutant p53, tyrosinase, AZT, angiostatin, endostatin, or a combination thereof, may be included in formulations of, or for co-administration with, the compositions.

The pharmaceutical compositions can be administered in a therapeutically effective amount that provides an immunogenic and/or protective effect against an infective agent (e.g., a 2019-nCoV). In some embodiments, a composition comprising a nucleic acid molecule, polypeptide, vector, and/or antibodies may be formulated for administration at a dose of at least 1-1,000 pg (e.g., at least 15, 16, 17, 18, 19, 20, 30, 40, 50, 60, 70, 80, 90, 100, 125, 150, 175, 200, 225, 250, 275, or 300 pg or more). The dose may be in a volume of 0.2 mL to 1.0 mL or up to 1 L (e.g., if prepared as an infusion). In some embodiments, a composition comprising a nucleic acid molecule, vector, and/or vaccine is administered at a dose of 50 pg.

The compositions utilized in the methods described herein can be formulated, for example, for administration intramuscularly, intravenously, intradermally, percutaneously, intraarterially, intraperitoneally, intralesionally, intracranially, intraarticularly, intraprostatically, intrapleurally, intratracheally, intranasally, intravitreally, intravaginally, intrarectally, topically, intratumorally, peritoneally, subcutaneously, subconjunctivally, intravesicularlly, mucosally, intrapericardially, intraumbilically, intraocularly, orally, topically, locally, by inhalation, by injection, by infusion, by continuous infusion, by localized perfusion bathing target cells directly, by catheter, by lavage, by gavage, in cremes, or in lipid compositions.

Pharmaceutical compositions according to the invention described herein may be formulated to release the composition immediately upon administration (e.g., targeted delivery) or at any predetermined time period after administration using controlled or extended release formulations. Administration of the pharmaceutical composition in controlled or extended release formulations is useful where the composition, either alone or in combination, has (i) a narrow therapeutic index (e.g., the difference between the plasma concentration leading to harmful side effects or toxic reactions and the plasma concentration leading to a therapeutic effect is small; generally, the therapeutic index, TI, is defined as the ratio of median lethal dose ($LD_{50}$) to median effective dose ($ED_{50}$)); (ii) a narrow absorption window at the site of release (e.g., the gastro-intestinal tract); or (iii) a short biological half-life, so that frequent dosing during a day is required in order to sustain a therapeutic level.

Many strategies can be pursued to obtain controlled or extended release in which the rate of release outweighs the rate of metabolism of the pharmaceutical composition. For example, controlled release can be obtained by the appropriate selection of formulation parameters and ingredients, including, e.g., appropriate controlled release compositions and coatings. Suitable formulations are known to those of skill in the art. Examples include single or multiple unit tablet or capsule compositions, oil solutions, suspensions, emulsions, microcapsules, microspheres, nanoparticles, patches, and liposomes.

The compositions may be sterilized by conventional sterilization techniques or may be sterile filtered. The resulting aqueous solutions may be packaged for use as is, or lyophilized, the lyophilized preparation may be administered in powder form or combined with a sterile aqueous carrier prior to administration. The pH of the preparations typically will be between 3 and 11, more preferably between 5 and 9 or between 6 and 8, and most preferably between 7 and 8, such as 7 to 7.5. The resulting compositions in solid form may be packaged in multiple single dose units, each containing a fixed amount of an immunogenic composition (e.g., a vaccine or an anti-2019-nCoV antibody) and, if desired, one or more immunomodulatory agents, such as in a sealed package of tablets or capsules, or in a suitable dry powder inhaler (DPI) capable of administering one or more doses.

Methods of Treatment Using Compositions

The pharmaceutical compositions (e.g., immunogenic compositions and anti-2019-nCoV antibodies) can be used to treat a subject (e.g., a human) at risk of exposure (e.g., due to travel to a region where coronavirus (e.g., 2019-nCoV) infection is prevalent) to a coronavirus (e.g., 2019-nCoV), a subject susceptible to a coronavirus (e.g., 2019-nCoV) infection, or to treat a subject having a coronavirus (e.g., 2019-nCoV) infection. In particular, the compositions can be used to treat (pre- or post-exposure) infection by a 2019-nCoV. In some embodiments, the treatment can induce a protective level of anti-coronavirus antibodies (e.g., anti-2019-nCoV antibodies, e.g., anti-Spike antibodies, e.g., anti-Spike neutralizing antibodies). In some embodiments, the protective level is a titer of at least about 70 as measured using the pseudovirus neutralization assay described herein, a titer of at least about 25 as measured using the live virus neutralization assay described herein, or is above a level of at least about 80% of a median or mean level of a cohort of convalescent humans as determined by a pseudovirus neutralization assay or live virus neutralization assay as described herein. In some embodiments, treatment with a composition may reduce a 2019-nCoV-mediated activity in a subject, such as viral titer, viral spread, infection, and or cell fusion. In some embodiments, 2019-nCoV-mediated activity is viral load in the respiratory tract (e.g., the upper respiratory tract and/or the lower respiratory tract). In some embodiments, 2019-nCoV-mediated activity is viral load in the lung, nares, and/or trachea. In some embodiments, the 2019-nCoV viral load is decreased by about 1% or more (e.g., 2%, 3%, 4%, 5%, 6%, 7%, 8%, 9%, 10%, 20%, 30%, 40%, 50%, 60%, 70%, 80%, 90%, 95%, 99%, 99.9%, 99.99%, or more). In some embodiments, 2019-nCoV titer in a treated subject infected with 2019-nCoV is decreased by at least about 1% or more (e.g., 2%, 3%, 4%, 5%, 6%, 7%, 8%, 9%, 10%, 20%, 30%, 40%, 50%, 60%, 70%, 80%, or 90%, 95%, 99%, 99.9%, 99.99%, or more) after administration of a composition (e.g., vaccine) to the subject.

The compositions (e.g., any of the compositions described herein) can be used to induce an immune response (e.g., a humoral and/or cellular immune response) in a subject (e.g., a human subject). The immune response induced may be different (e.g., different in the specificity, robustness, or durability) depending on the composition or combination of compositions administered. For example, a composition can induce an antibody response with different antibody types (e.g., different proportions of IgM, IgA, IgG1, IgG2, IgG3, or FcgR2A.1) or different functional characteristics (e.g., ability to induce antibody-dependent neutrophil phagocytosis (ADNP), antibody-dependent complement deposition (ADCD), antibody-dependent monocyte cellular phagocytosis (ADCP), or antibody-dependent NK cell activation (IFN-γ secretion, CD107a degranulation, and MIP-1β expression)). Compositions described herein (e.g., SS-Spike and SS-SdCT) may induce an ADCD response that can be monitored (e.g., to assess therapeutic efficacy). Compositions described herein (e.g., SS-RBD-foldon and SS-S.Ecto-dF-PP-foldon) may induce an antibody-dependent NK cell activation response that can be monitored (e.g., to assess therapeutic efficacy). Compositions may also induce cellular responses with different characteristics (e.g., Th1, Th2, or Th17 responses). Compositions described herein (e.g., SS-Spike, SS-SdCT, and SS-S.Ecto-dF-PP-foldon) may induce an S-specific $CD4^+$ or $CD8^+$ T cell response that can be monitored (e.g., to assess therapeutic efficacy).

The vectors (e.g., mammalian, bacterial, or viral (e.g., Ad26) derived expression vectors) can be used to deliver a nucleic acid expressing an immunogen (e.g., one of more of SEQ ID NOs: 1-84 or variants thereof, having at least 85-99% sequence identity thereto, for example at least greater than 90% sequence identity thereto) to a subject in a method of preventing and/or treating a 2019-nCoV infection. For example, a vector can be used to deliver a nucleic acid (e.g., a nucleic acid containing the nucleotide sequence of SEQ ID NOs: 104 or 204) expressing an immunogen with the amino acid sequence of SEQ ID NO: 51. For example, a vector can be used to deliver a nucleic acid (e.g., a nucleic acid containing the nucleotide sequence of SEQ ID NO: 195) expressing an immunogen with the amino acid sequence of SEQ ID NO: 56. The vectors (e.g., mammalian, bacterial, or viral derived expression vectors) can be genetically modified to contain one or more nucleic acid sequences set forth in SEQ ID NOs: 93-181, 190-195, and 199-204 or variants thereof having at least 85-99% sequence identity thereto, for example at least greater than 90% sequence identity thereto, and complements thereof. In particular, adenoviral vectors (e.g., vectors derived from Ad2, Ad5, Ad11, Ad12, Ad24, Ad26, Ad34, Ad35, Ad40, Ad48, Ad49, Ad50, Ad52 (RhAd52), Ad59 (RhAd59), and Pan9 (also known as AdC68)) disclosed in International Patent Application Publications WO 2006/040330 and WO 2007/104792, each incorporated by reference herein, are particularly useful as vectors in methods of delivering an immunogen to a subject. For example, the vector can be Ad26. Other examples of vectors are described, for example, in McVey et al., (U.S. Pat. No. 5,801,030); incorporated herein, in its entirety, by reference.

Useful gene therapy methods for the delivery of immunogens to a subject in need thereof include those described in PCT publication no. WO 2006/060641, U.S. Pat. No. 7,179,903, and PCT publication no. WO 2001/036620, which described the use of, for example, an adenovirus vector (e.g., vectors derived from Ad2, Ad5, Ad11, Ad12, Ad24, Ad26, Ad34, Ad35, Ad40, Ad48, Ad49, Ad50, Ad52 (RhAd52), Ad59 (RhAd59), and Pan9 (also known as AdC68)) for therapeutic protein delivery.

One or more of any of the compositions (e.g., pharmaceutical compositions (e.g., immunogenic compositions and anti-2019-nCoV antibodies)) described herein can be used in a treatment. The treatment can include one or more additional therapeutic agents (e.g., proinflammatory (e.g., interferons) or anti-inflammatory agents (e.g., corticosteroids, e.g., dexamethasone)) and/or one or more therapeutic interventions (e.g., surgery and prone positioning). The therapeutic agents and/or interventions can be administered sequentially (e.g., administration of one or more of any of the compositions described herein before disease or at an early stage of disease (e.g., within a week of symptom onset), then administration of an additional therapeutic agent (e.g., an anti-inflammatory agent (e.g., a corticosteroid, e.g., dexamethasone) at a later stage of disease (e.g., after a week of symptom onset))) or simultaneously (e.g., administration of one or more of any of the compositions described herein and/or one or more additional therapeutic agents). Additional therapeutic agents can include corticosteroids (e.g., glucocorticoids (e.g., dexamethasone, prednisone, and hydrocortisone)), interferons (e.g., interferon beta), deoxycholic acid, colony stimulating factors (e.g., G-CSF and GM-CSF), and non-steroidal anti-inflammatory drugs (e.g., aspirin, propionic acid derivatives such as ibuprofen, fenoprofen, ketoprofen, flurbiprofen, oxaprozin and naproxen, acetic acid derivatives such as sulindac, indomethacin, etodolac, diclofenac, enolic acid derivatives such as piroxicam, meloxicam, tenoxicam, droxicam, lornoxicam and isoxicam, fenamic acid derivatives such as mefenamic acid, meclofenamic acid, flufenamic acid, tolfenamic acid, and COX-2 inhibitors such as celecoxib, etoricoxib, lumiracoxib, parecoxib, rofecoxib, rofecoxib, and valdecoxib). Other agents that can be administered in combination with the compositions described herein include remdesivir, chloroquine, hydroxychloroquine, baricitinib, lopinavir/ritonavir, umifenovir, favipiravir, tocilizumab, and ribavirin.

Administration

The pharmaceutical compositions can be administered to a subject (e.g., a human) pre- or post-exposure to an infective agent (e.g., a coronavirus, such as 2019-nCoV) to treat, prevent, ameliorate, inhibit the progression of, or reduce the severity of one or more symptoms of infection (e.g., a coronavirus infection, such as a 2019-nCoV infection). For example, the compositions can be administered to a subject having a 2019-nCoV infection. Examples of symptoms of diseases caused by a viral infection, such as 2019-nCoV, that can be treated using the compositions include, for example, fever, pneumonia, respiratory failure, weight loss, joint pain, rash, conjunctivitis, muscle pain, headache, retro-orbital pain, edema, lymphadenopathy, malaise, asthenia, sore throat, cough, nausea, vomiting, diarrhea, and hematospermia. These symptoms, and their resolution during treatment, may be measured by, for example, a physician during a physical examination or by other tests and methods known in the art. A pharmaceutical composition described herein can be administered to a subject (e.g., a human) pre- or post-exposure to an infective agent (e.g., a coronavirus, such as 2019-nCoV) to reduce or prevent the risk of mortality caused by the agent.

The preferred method of administration can vary depending on various factors (e.g., the components of the composition being administered, and the severity of the condition being treated). Formulations suitable for oral or nasal administration may consist of liquid solutions, such as an effective amount of the composition dissolved in a diluent (e.g., water, saline, or PEG-400), capsules, sachets, tablets, or gels, each containing a predetermined amount of the chimeric Ad5 vector composition. The pharmaceutical composition may also be an aerosol formulation for inhalation, for example, to the bronchial passageways. Aerosol formulations may be mixed with pressurized, pharmaceutically acceptable propellants (e.g., dichlorodifluoromethane, propane, or nitrogen). In particular, administration by inhalation can be accomplished by using, for example, an aerosol containing sorbitan trioleate or oleic acid, for example, together with trichlorofluoromethane, dichlorofluoromethane, dichlorotetrafluoroethane, or any other biologically compatible propellant gas.

Immunogenicity of the composition may be significantly improved if it is co-administered with an immunostimulatory agent and/or adjuvant. Suitable adjuvants well-known to those skilled in the art include, for example, aluminum phosphate, aluminum hydroxide, QS21, Quil A (and derivatives and components thereof), calcium phosphate, calcium hydroxide, zinc hydroxide, glycolipid analogs, octodecyl esters of an amino acid, muramyl dipeptides, polyphosphazene, lipoproteins, ISCOM matrix, DC-Chol, DDA, cytokines, and other adjuvants and derivatives thereof.

The compositions may be administered to provide pre-exposure prophylaxis or after a subject has been diagnosed as having a viral infection (e.g., 2019-nCoV infection) or a subject exposed to an infective agent, such as a virus (e.g., a coronavirus infection, such as a 2019-nCoV). The composition may be administered, for example, 1, 2, 3, 4, 5, 6, 7, 8, 9, 10, 15, 20, 30, 35, 40, 45, 50, 55, or 60 minutes, 2, 4, 6, 10, 15, or 24 hours, 2, 3, 5, or 7 days, 2, 4, 6 or 8 weeks, or even 3, 4, or 6 months pre-exposure to a 2019-nCoV, or may be administered to the subject 15-30 minutes or 1, 2, 3, 4, 5, 6, 7, 8, 9, 10, 12, 20, 24, 48, or 72 hours, 2, 3, 5, or 7 days, 2, 4, 6 or 8 weeks, 3, 4, 6, or 9 months, 1, 2, 3, 4, 5, 6, 7, 8, 9, 10, 15, or 20 years or post-exposure to a coronavirus (e.g., 2019-nCoV).

When treating viral infection (e.g., a 2019-nCoV infection), the compositions may be administered to the subject either before the occurrence of symptoms or a definitive diagnosis or after diagnosis or symptoms become evident. For example, the composition may be administered, for example, immediately after diagnosis or the clinical recognition of symptoms or 2, 4, 6, 10, 15, or 24 hours, 2, 3, 5, or 7 days after diagnosis or detection of symptoms. One or more doses (e.g., 1, 2, 3, 4, 5, 6, 7, 8, 9, or 10 doses) of an immunogenic composition or anti-2019-nCoV antibody-containing composition may be administered to a subject in need thereof. In some embodiments, a subject is administered at least one dose. In some embodiments, a subject is administered at least two doses. In some embodiments, doses are administered on the same day. In some embodiments, doses are administered on different days. In some embodiments, an immunogenic composition is administered to a subject in need thereof as a prime, a boost, or as a prime-boost. In some embodiments, the boost is administered 1, 2, 3, 4, 5, 6, 7, 8, 9, 10, 11, 12, 13, 14, 15, 16, 17, 18, 19, 20, 21, 22, 23, 24, 25, 26, 27, or 28 days, 5, 6, 7, 8, 9, 10, 11, or 12 weeks, 4, 5, 6, 7, 8, 9, 10, 11, 12, 13, 14, 15, 16, 17, 18, 19, 20, 21, 22, or 23 months, 2, 3, 4, 5, 6, 7, 8, 9, 10, 15, or 20 years after the prime of a prime-boost regimen. In other embodiments, multiple boost doses are administered, in which each boost does is administered at least 1, 2, 3, 4, 5, 6, 7, 8, 9, 10, 11, 12, 13, 14, 15, 16, 17, 18, 19, 20, 21, 22, 23, 24, 25, 26, 27, or 28 days, 5, 6, 7, 8, 9, 10, 11, or 12 weeks, 4, 5, 6, 7, 8, 9, 10, 11, 12, 13, 14, 15, 16, 17, 18, 19, 20, 21, 22, or 23 months, 2, 3, 4, 5, 6, 7, 8, 9, 10, 15, or 20 years apart.

One or more doses of any of the compositions described herein (e.g., any of the immunogenic compositions described herein) may be administered with one or more additional therapeutic agents either sequentially or simultaneously.

Dosages

The dose of the compositions or the number of treatments using the compositions may be increased or decreased based on the severity of, occurrence of, or progression of, the disease in the subject (e.g., based on the severity of one or more symptoms of, e.g., viral infection).

The pharmaceutical compositions can be administered in a therapeutically effective amount that provides an immunogenic and/or protective effect against an infective agent (e.g., a 2019-nCoV). In some embodiments, a composition comprising a nucleic acid molecule, polypeptide, vector, and/or antibodies may be administered in a dose of at least 1 µg to 100 mg (e.g., at least 10 µg, 20 µg, 30 µg, 40 µg, 50 µg, 60 µg, 70 µg, 80 µg, 90 µg, 100 µg, 125 µg, 150 µg, 175 µg, 200 µg, 225 µg, 250 µg, 275 µg, 300 µg, 325 µg, 350 µg, 375 µg, 400 µg, 425 µg, 450 µg, 475 µg, 500 µg, 525 µg, 550 µg, 575 µg, 600 µg, 625 µg, 650 µg, 675 µg, 700 µg, 725 µg, 750 µg, 775 µg, 800 µg, 825 µg, 850 µg, 875 µg, 900 µg, 925 µg, 950 µg, 975 µg, 1 mg, 2 mg, 3 mg, 4 mg, 5 mg, 6 mg, 7 mg, 8 mg, 9 mg, 10 mg, 11 mg, 12 mg, 13 mg, 14 mg, 15 mg, 16 mg, 17 mg, 18 mg, 19 mg, 20 mg, 25 mg, 30 mg, 40 mg, 50 mg, 60 mg, 70 mg, 80 mg, 90 mg or more). In some embodiments, a composition comprising a nucleic acid molecule, vector, and/or antibody is administered at a dose of about 50 pg (e.g., a dose between about 25 pg and about 75 pg). In some embodiments, a composition comprising a nucleic acid molecule, vector, and/or antibody is administered at a dose of about 5 mg (e.g., a dose of about 1 mg to about 10 mg). In some instances, administration of an effective amount of a composition (e.g., an immunogen, such as SEQ ID NOs: 1-84) induces a protective level (e.g., above a titer of at least about 70 as measured using the pseudovirus neutralization assay described herein, above a titer of at least about 25 as measured using the live virus neutralization assay described herein, or is above a level of at least about 80% of a median or mean level of a cohort of convalescent humans as determined by a pseudovirus neutralization assay or live virus neutralization assay as described herein) of anti-coronavirus antibodies (e.g., anti-2019-nCoV antibodies, e.g., anti-Spike antibodies, e.g., anti-Spike neutralizing antibodies). In some instances, the protective level is a titer of at least about 70 (e.g., at least about 80, at least about 100, or at least about 120) as measured using the pseudovirus neutralization assay described herein. In some instances, the protective level is a titer of at least about 100, as measured using the pseudovirus neutralization assay described herein. In some instances, administration of an effective amount of a composition results in a protective level of anti-coronavirus antibodies (e.g., anti-2019-nCoV antibodies, e.g., anti-Spike antibodies, e.g., anti-Spike neutralizing antibodies) that are maintained for at least about 1, 2, 3, 4, 5, 6, 7, 8, 9, 10, 11, or 12 months or 1, 2, 3, 4, 5, 6, 7, 8, 9, 10, 11, 12, 13, 14, 15 years or more.

In some instances, administration of an effective amount of a composition (e.g., an immunogen, such as SEQ ID NOs: 1-84) reduces 2019-nCoV serum viral loads determined from a subject having a 2019-nCoV infection by at least about 5%, 10%, 20%, 30%, 40%, 50%, 60%, 70%, 80%, 90%, or more compared to viral loads determined from the patient prior to administration of an effective amount of a composition. In some instances, administration of an effective amount of a composition reduces serum viral loads to an undetectable level compared to viral loads determined from the patient prior to administration of an effective amount of a composition. In some instances, administration of an effective amount of a composition results in a reduced and/or undetectable serum viral load that may be maintained for at least about 1, 2, 3, 4, 5, 6, 7 days; 1, 2, 3, 4, weeks; 1, 2, 3, 4, 5, 6, 7, 8, 9, 10, 11, or 12 months; or 1 year or more.

The dosage administered depends on the subject to be treated (e.g., the age, body weight, capacity of the immune system, and general health of the subject being treated), the form of administration (e.g., as a solid or liquid), the manner of administration (e.g., by injection, inhalation, or dry powder propellant), and the cells targeted (e.g., epithelial cells, such as blood vessel epithelial cells, nasal epithelial cells, or pulmonary epithelial cells). The composition is preferably administered in an amount that provides a sufficient level of the antigenic or therapeutic gene product, or fragment thereof (e.g., a level of an antigenic gene product that elicits an immune response without undue adverse physiological effects in the host caused by the antigenic gene product).

The method of delivery, for example of a DNA or RNA vaccine, may also determine the dose amount. In some cases, dosage administered by injections by intravenous (i.v.) or intramuscular (i.m.) route may require variable amounts of a DNA or RNA vaccine, for example from 10 pg-1 mg. However, administration using a gene gun may require a dose of a DNA or RNA vaccine between 0.2 pg and 20 pg (e.g., 0.2, 0.1, 0.3, 0.4, 0.5, 0.6, 0.7, 0.8, 0.9, 1, 2, 3, 4, 5, 6, 7, 8, 9, 10, 11, 12, 13, 14, 15, 16, 17, 18, 19, or 20 pg). In some instances, the use of a gene gun to deliver a dose of a DNA or RNA vaccine may require only ng quantities of DNA or RNA, for example between 10 ng and 200 ng (e.g., 10, 12, 13, 14, 15, 16, 17, 18, 19, 20.30, 40, 50, 60, 70, 80, 90, 100, 125, 150, 175, or 200 ng).

In other embodiments wherein the delivery vector is a virus (e.g., an Ad26 virus), the subject can be administered at least about $1\times10^3$ viral particles (VP)/dose or between $1\times10^1$ and $1\times10^{20}$ VP/dose (e.g., $1\times10^1$, $1\times10^2$, $1\times10^3$, $1\times10^4$, $1\times10^5$, $1\times10^6$, $1\times10^7$, $1\times10^8$, $1\times10^9$, $1\times10^{10}$, $1\times10^{11}$, $1\times10^{12}$, $1\times10^{13}$, $1\times10^{14}$, $1\times10^{15}$, $1\times10^{16}$, $1\times10^{17}$, $1\times10^{18}$, $1\times10^{19}$, or $1\times10^{20}$ VP/dose). For example, the subject can be administered about $1\times10^6$ to about $1\times10^{14}$ VP/dose (e.g., about $1\times10^7$, about $1\times10^8$, about $1\times10^9$, about $1\times10^{10}$, about $1\times10^{11}$, about $1\times10^{12}$, about $1\times10^{13}$, about $1\times10^{14}$, or about $1\times10^{15}$ VP/dose). For example, the subject can be administered about $1\times10^{11}$, about $1\times10^{12}$, about $1\times10^{13}$, or about $1\times10^{14}$ VP/dose.

In addition, single or multiple administrations of the compositions of the present invention may be given (pre- or post-exposure and/or pre- or post-diagnosis) to a subject (e.g., one administration or administration two or more times). For example, subjects who are particularly susceptible to, for example, viral infection (e.g., a 2019-nCoV infection) may require multiple treatments to establish and/or maintain protection against the virus. Levels of induced immunity provided by the pharmaceutical compositions described herein can be monitored by, for example, measuring amounts of neutralizing secretory and serum antibodies. The dosages may then be adjusted or repeated as necessary to trigger the desired level of immune response. For example, the immune response triggered by a single administration (prime) of a composition may not sufficiently potent and/or persistent to provide effective protection. Accordingly, in some embodiments, repeated administration (boost), such that a prime boost regimen is established, can significantly enhance humoral and cellular responses to the antigen of the composition.

Alternatively, the efficacy of treatment can be determined by monitoring the level of the antigenic or therapeutic gene product, or fragment thereof, expressed in a subject (e.g., a human) following administration of the compositions. For example, the blood or lymph of a subject can be tested for antigenic or therapeutic gene product, or fragment thereof, using, for example, standard assays known in the art.

In some instances, efficacy of treatment can be determined by monitoring a change in the serum viral load from a sample from the subject obtained prior to and after administration of an effective amount of a composition (e.g., an immunogen, such as any one of SEQ ID NOs: 1-84). A reduction in serum viral load of at least about 5%, 10%, 20%, 30%, 40%, 50%, 60%, 70%, 80%, 90%, or more compared to viral load determined from the subject prior to administration of an effective amount of a composition may indicate that the subject is receiving benefit from the treatment. If a viral load does not decrease by at least about 10%, 20%, 30%, or more after administration of a composition, the dosage of the composition to be administered may be increased. For example, by increasing the pg or mg amount of a DNA vaccine (e.g., a DNA vaccine containing one or more of SEQ ID NOs: 93-181, 190-195, and 199-204) administered to the subject or by increasing the number of viral particles (VP) of an adenovirus vector-based vaccine (e.g., an adenovirus vector-based vaccine containing one or more of SEQ ID NOs: 93-181, 190-195, and 199-204).

A single dose of a composition may achieve protection, pre-exposure or pre-diagnosis. In addition, a single dose administered post-exposure or post-diagnosis can function as a treatment according to the present invention.

A single dose of a composition can also be used to achieve therapy in subjects being treated for an infection (e.g., a coronavirus infection, such as a 2019-nCoV infection).

Multiple doses (e.g., 2, 3, 4, 5, 6, 7, 8, 9, 10, 15, 20 or more doses) can also be administered, in necessary, to these subjects.

Methods of Diagnosing and Predicting Susceptibility to Coronavirus Infection

Diagnostic Methods

Provided herein are methods for identifying, diagnosing, and/or predicting the susceptibility of a subject to a coronavirus infection. The method includes measuring the level or amount of an anti-coronavirus antibody (e.g., an anti-Spike antibody) in a sample (e.g., a whole blood sample, e.g., a serum or plasma sample) from the subject. In some embodiments, the coronavirus is 2019-nCoV. In some embodiments, the anti-coronavirus antibody (e.g., an anti-Spike antibody) is a neutralizing antibody. In some embodiments, the subject is determined to be susceptible to the coronavirus infection if the anti-coronavirus antibody (e.g., an anti-Spike antibody) amount or level is below a protective level (e.g., below a titer of at least about 70 as measured using the pseudovirus neutralization assay described herein, below a titer of at least about 25 as measured using the live virus neutralization assay described herein, or below 80% of a median level of a cohort of convalescent humans (e.g., a group of humans who have recovered or are recovering from a coronavirus infection (e.g., 2019-nCoV)) as determined by a pseudovirus neutralization assay or live virus neutralization assay) and determined to not be susceptible to the coronavirus infection if the anti-coronavirus antibody (e.g., an anti-Spike antibody) level is above a protective level. In some embodiments, the protective level is an anti-coronavirus antibody titer (e.g., an anti-Spike neutralizing antibody titer) of at least about 70 (e.g., about 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 110, 115, 120, 125, 130, 140, 150, 175, 200, 225, 250, 275, 300, 325, 350 or more) as determined in a pseudovirus neutralization assay. In some embodiments, the protective level is an anti-coronavirus antibody titer (e.g., an anti-Spike neutralizing antibody titer) of at least about 83 as determined in a pseudovirus neutralization assay. In some embodiments, the protective level is an anti-coronavirus antibody titer (e.g., an anti-Spike neutralizing antibody titer) of at least about 25 (e.g., about 25, 26, 27, 28, 29, 30, 31, 32, 33, 34, 35, 36, 37, 38, 39, 40, 41, 42, 43, 44, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 110, 115, 120, 125, 130, 140, 150, 175, 200 or more) as determined in a live virus neutralization assay. In some embodiments, the protective level is an anti-coronavirus antibody titer (e.g., an anti-Spike neutralizing antibody titer) of at least about 35 as determined in a live virus neutralization assay In some embodiments, the protective level is an anti-coronavirus antibody titer (e.g., an anti-Spike neutralizing antibody titer) that is at least about 60% (e.g., about 61%, about 62%, about 63%, about 64%, about 65%, about 66%, about 67%, about 68%, about 69%, about 70%, about 71%, about 72%, about 73%, about 74%, about 75%, about 76%, about 77%, about 78%, about 79%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, about 100%, about 110%, about 120%) of a median or mean level of a cohort of convalescent humans as determined by a pseudovirus neutralization assay or live virus neutralization assay as described herein. In some embodiments, the protective level is an anti-coronavirus antibody titer (e.g., an anti-Spike neutralizing antibody titer) that is at least about 80% of a median or mean level of a cohort of convalescent humans as determined by a pseudovirus neutralization assay or live virus neutralization assay as described herein. A subject determined to be susceptible to the coronavirus infection (a subject with an anti-coronavirus antibody (e.g., an anti-Spike antibody) amount or level is below a protective level (e.g., below a titer of at least about 70 as measured using the pseudovirus neutralization assay described herein, below a titer of at least about 25 as measured using the live virus neutralization assay described herein, or below 80% of a median level of a cohort of convalescent humans (e.g., a group of humans who have recovered or are recovering from a coronavirus infection (e.g., 2019-nCoV)) as determined by a pseudovirus neutralization assay or live virus neutralization assay)) can be administered a therapy (e.g., administered any of the compositions described herein), such as an effective amount of one or more of the pharmaceutical compositions (e.g., immunogenic compositions and anti-2019-nCoV antibodies) described herein. A subject may be re-administered a therapy until the subject is determined to not be susceptible to the coronavirus infection (e.g., until the subject has an anti-coronavirus antibody (e.g., an anti-Spike antibody) level is above a protective level (e.g., a level above a titer of at least about 70 as measured using the pseudovirus neutralization assay described herein, above a titer of at least about 25 as measured using the live virus neutralization assay described herein, or is at a level that is at least 80% of a median level (and preferably at or above a median level) of an anti-coronavirus antibody of a cohort of convalescent humans (e.g., a group of humans who have recovered or are recovering from a coronavirus infection (e.g., 2019-nCoV)) as determined by a pseudovirus neutralization assay or live virus neutralization assay)). The method may also involve determining whether the anti-Spike antibody is an RBD-specific antibody. The method may also involve determining whether the anti-Spike antibody is an S1-specific antibody. The method may also involve determining whether the anti-Spike antibody is an S2-specific antibody. The method may also involve identifying the subclass (e.g., IgM, IgA, IgG1, IgG2, IgG3, or FcgR2A.1) and/or effector function (e.g., antibody-dependent neutrophil phagocytosis (ADNP), antibody-dependent complement deposition (ADCD), antibody-dependent monocyte cellular phagocytosis (ADCP), or antibody-dependent NK cell activation (IFN-γ secretion, CD107a degranulation, and MIP-1β expression)) of the anti-coronavirus antibody. The method may further include administering one or more of the pharmaceutical compositions (e.g., immunogenic compositions and anti-2019-nCoV antibodies) described herein to a subject determined to be in need of further therapy.

The method may include measuring the coronavirus (e.g., 2019-nCoV) viral load in a sample from the subject. In some embodiments, the sample is a bronchoalveolar lavage (BAL) or a nasal swab (NS). In some embodiments, the sample is a bodily fluid (e.g., blood, e.g., whole blood or plasma) from the subject. In some embodiments, the sample is a tissue sample (e.g., a respiratory tract tissue sample) from the subject. In some embodiments, viral load is a detectible nucleic acid (e.g., subgenomic mRNA) level or a detectible protein (e.g., nucleocapsid protein (N)) level. In some embodiments, the detectible nucleic acid (e.g., subgenomic mRNA) is determined by RNA-seq, RT-qPCR, qPCR, multiplex qPCR or RT-qPCR, LAMP, microarray analysis, or hybridization (e.g., ISH (e.g., FISH)). In some embodiments, the detectible protein (e.g., nucleocapsid protein (N))

is determined by an immunoassay (e.g., an immunohistochemical (IHC) assay or a lateral flow immunoassay). In some embodiments, a detectable viral load indicates that the subject is susceptible to disease (e.g., a 2019-nCoV-mediated disease, e.g., COVID-19, e.g., severe COVID-19 disease). In some embodiments, a viral load of greater than at least about 3.5 $\log_{10}$ sgmRNA copies/mL (e.g., about 3.75 $\log_{10}$ sgmRNA copies/mL, about 3.8 $\log_{10}$ sgmRNA copies/mL, about 3.9 $\log_{10}$ sgmRNA copies/mL, about 4.0 $\log_{10}$ sgmRNA copies/mL, about 4.25 $\log_{10}$ sgmRNA copies/mL, about 4.5 $\log_{10}$ sgmRNA copies/mL, about 4.75 $\log_{10}$ sgmRNA copies/mL, about 5.0 $\log_{10}$ sgmRNA copies/mL, about 5.5 $\log_{10}$ sgmRNA copies/mL, about 6.0 $\log_{10}$ sgmRNA copies/mL, about 6.5 $\log_{10}$ sgmRNA copies/mL, about 7.0 $\log_{10}$ sgmRNA copies/mL, about 7.5 $\log_{10}$ sgmRNA copies/mL, about 8.0 $\log_{10}$ sgmRNA copies/mL, about 8.5 $\log_{10}$ sgmRNA copies/mL, about 9 $\log_{10}$ sgmRNA copies/mL, about 10 $\log_{10}$ sgmRNA copies/mL, about 11 $\log_{10}$ sgmRNA copies/mL, about 12 $\log_{10}$ sgmRNA copies/mL, about 13 $\log_{10}$ sgmRNA copies/mL or more). In some embodiments, a viral load of greater than 3.85 $\log_{10}$ sgmRNA copies/mL in BAL or 3.78 $\log_{10}$ sgmRNA copies/mL in NS indicates that the subject is susceptible to disease (e.g., a 2019-nCoV-mediated disease, e.g., COVID-19, e.g., severe COVID-19 disease). In some embodiments, a viral load of greater than 3.85 $\log_{10}$ sgmRNA copies/mL in BAL or 3.78 $\log_{10}$ sgmRNA copies/mL in NS indicates that the subject is susceptible to severe COVID-19 disease. In some embodiments, a viral load of greater than about 2.0 $\log_{10}$ sgmRNA copies/g (e.g., about 2.0 $\log_{10}$ sgmRNA copies/g, about 2.5 $\log_{10}$ sgmRNA copies/g, about 3.0 $\log_{10}$ sgmRNA copies/g, about 3.5 $\log_{10}$ sgmRNA copies/g, about 4.0 $\log_{10}$ sgmRNA copies/g, about 4.25 $\log_{10}$ sgmRNA copies/g, about 4.5 $\log_{10}$ sgmRNA copies/g, about 4.75 $\log_{10}$ sgmRNA copies/g, about 5.0 $\log_{10}$ sgmRNA copies/g, about 5.5 $\log_{10}$ sgmRNA copies/g, about 6.0 $\log_{10}$ sgmRNA copies/g, about 6.5 $\log_{10}$ sgmRNA copies/g, about 7.0 $\log_{10}$ sgmRNA copies/g, about 7.5 $\log_{10}$ sgmRNA copies/g, about 8.0 $\log_{10}$ sgmRNA copies/g, about 8.5 $\log_{10}$ sgmRNA copies/g, about 9 $\log_{10}$ sgmRNA copies/g, about 10 $\log_{10}$ sgmRNA copies/g, about 11 $\log_{10}$ sgmRNA copies/g, about 12 $\log_{10}$ sgmRNA copies/g, about 13 $\log_{10}$ sgmRNA copies/g or more) of tissue indicates that the subject is susceptible to severe COVID-19 disease. In some embodiments, a viral load of greater than about 8.0 $\log_{10}$ sgmRNA copies/g in lung tissue, about 7.0 $\log_{10}$ sgmRNA copies/g in nares tissue, about 6.0 $\log_{10}$ sgmRNA copies/g in trachea tissue, about 5.5 $\log_{10}$ sgmRNA copies/g in heart tissue, or about 2.0 $\log_{10}$ sgmRNA copies/g in GI, spleen, liver, kidney, or brain tissue indicates that the subject is susceptible to severe COVID-19 disease. In some embodiments, a viral load of greater than about 3% (e.g., about 4%, about 5%, about 6%, about 7%, about 8%, about 9%, about 10%) SARS-CoV-2 vRNA staining by ISH indicates that the subject is susceptible to disease (e.g., a 2019-nCoV-mediated disease, e.g., COVID-19, e.g., severe COVID-19 disease). In some embodiments, a viral load of greater than about 5% (e.g., about 5%, about 6%, about 7%, about 8%, about 9%, about 10%) SARS-CoV-2 vRNA staining by ISH indicates that the subject is susceptible to severe COVID-19 disease. In some embodiments, a viral load of greater than about 5% (e.g., about 5%, about 6%, about 7%, about 8%, about 9%, about 10%) SARS-CoV-2 vRNA staining by ISH indicates that the subject is susceptible to severe COVID-19 disease. In some embodiments, coronavirus (e.g., 2019-nCoV) viral load is measured one or more times over about 1, 2, 3, 4, 5, or 6 days or 1, 2, 3, 4, 5, 6, or 7 weeks post-infection.

Monitoring Responsiveness

Provided herein are methods for monitoring an anti-coronavirus immune response of a subject to a therapeutic composition (e.g., any of the compositions or immunogenic compositions described herein or known in the art) for treating or reducing the risk of a coronavirus infection. The method includes measuring the level or amount of an anti-coronavirus antibody (e.g., an anti-Spike antibody) in the subject. In some embodiments, the coronavirus is 2019-nCoV. In some embodiments, the anti-coronavirus antibody (e.g., an anti-Spike antibody) is a neutralizing antibody. The anti-coronavirus antibody (e.g., an anti-Spike antibody, e.g., an anti-Spike neutralizing antibody) may be measured in a short timeframe (e.g., in order to measure the robustness of the antibody response) or a longer timeframe (e.g., in order to measure the durability of the antibody response) after administration of a therapeutic composition (e.g., any of the compositions or immunogenic compositions described herein). In some embodiments, the anti-coronavirus antibody (e.g., an anti-Spike antibody) is measured about 1, 2, 3, 4, 5, 6, 7, 8, 9, 10, 11, 12, 13, 14, 15, 16, 17, 18, 19, 20, 21, 22, 23, 24, 25, 26, 27, or 28 days, about 5, 6, 7, 8, 9, 10, 11, or 12 weeks, about 4, 5, 6, 7, 8, 9, 10, 11, 12, 13, 14, 15, 16, 17, 18, 19, 20, 21, 22, or 23 months, or about 2, 3, 4, 5, 6, 7, 8, 9, 10, 15, or 20 years after the subject is administered the therapeutic composition (e.g., any of the compositions or immunogenic compositions described herein).

The subject is determined to be responsive to the therapeutic composition if the anti-coronavirus antibody (e.g., an anti-Spike antibody) detected in the subject (e.g., in the subject's blood) is above a protective level (e.g., above a titer of at least about 70 as measured using the pseudovirus neutralization assay described herein, above a titer of at least about 25 as measured using the live virus neutralization assay described herein, or is at a level that is at least 80% of a median level (and preferably at or above a median level) of an anti-coronavirus antibody of a cohort of convalescent humans (e.g., a group of humans who have recovered or are recovering from a coronavirus infection (e.g., 2019-nCoV)) as determined by a pseudovirus neutralization assay or live virus neutralization assay). Alternatively, the subject is determined to be non-responsive to the therapeutic composition if the anti-coronavirus antibody (e.g., an anti-Spike antibody) detected in the subject is below a protective level (e.g., below a titer of at least about 70 as measured using the pseudovirus neutralization assay described herein, below a titer of at least about 25 as measured using the live virus neutralization assay described herein, or is at a level that is below 80% of a median level of a cohort of convalescent humans as determined by a pseudovirus neutralization assay or live virus neutralization assay). A protective level of an anti-coronavirus antibody (e.g., an anti-Spike neutralizing antibody) corresponds to a titer of at least about 70 (e.g., about 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 110, 115, 120, 125, 130, 140, 150, 175, 200, 225, 250, 275, 300, 325, 350 or more) as determined in a pseudovirus neutralization assay (e.g., the pseudovirus neutralization assay described herein). In some embodiments, the protective level is an anti-coronavirus antibody titer (e.g., an anti-Spike neutralizing antibody titer) of at least about 25 (e.g., about 25, 26, 27, 28, 29, 30, 31, 32, 33, 34, 35, 36, 37, 38, 39, 40, 41, 42, 43, 44, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 110, 115, 120, 125, 130, 140, 150, 175, 200 or more) as determined in a live virus neutralization assay (e.g., the pseudovirus neutralization assay described herein). In some embodiments, the protective level is an anti-coronavirus antibody titer (e.g., an anti-Spike neutralizing antibody titer) that is at least about 60% (e.g., about 61%, about 62%, about 63%, about 64%, about 65%, about 66%, about 67%, about 68%, about 69%, about 70%, about 71%, about 72%, about 73%, about 74%, about 75%, about 76%, about 77%, about 78%, about 79%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, about 100%, about 110%, about 120%) of a median or mean level of a cohort of convalescent humans as determined by a pseudovirus neutralization assay or live virus neutralization assay as described herein.

If, over time, an anti-coronavirus antibody (e.g., an anti-Spike antibody) titer in the subject (e.g., in the blood of a subject) falls below or fails to reach a protective level (e.g., below a titer of at least about 70 as measured using the pseudovirus neutralization assay described herein, below a titer of at least about 25 as measured using the live virus neutralization assay described herein, or below 80% of a median level of a cohort of convalescent humans as determined by a pseudovirus neutralization assay or live virus neutralization assay described herein), the subject may be administered or may be re-administered a coronavirus vaccine composition (e.g., one or more of the therapeutic or immunogenic compositions described herein) alone or in combination with an additional therapeutic agent, such as one or more of the additional therapeutic agents described herein. Administration of a composition of the present disclosure to a subject in need thereof can be performed one or more times (e.g., 1, 2, 3, 4, 5, 6, 7, 8, 9, 10, 11, 12, 13, 14, 15 or more times) over one or more days (e.g., 1, 2, 3, 4, 5, 6, or 7 days), weeks (e.g., 1, 2, 3, 4, 5, 6, 7, or 8 weeks), months (e.g., 2, 3, 4, 5, 6, 7, 8, 9, 10, 11, or 12 months), or years (e.g., 1, 2, 3, 4, 5, 6, 7, 8, 9, 10 or more years), or over the life of the subject, as needed to maintain a protective level of an anti-coronavirus antibody in the subject, thereby protecting the subject against coronavirus infection (e.g., infection by 2019-nCoV).

The method may include measuring the coronavirus (e.g., 2019-nCoV) viral load in a sample from the subject. In some embodiments, the coronavirus is 2019-nCoV. In some embodiments, the viral load is measured about 1, 2, 3, 4, 5, 6, 7, 8, 9, 10, 11, 12, 13, 14, 15, 16, 17, 18, 19, 20, 21, 22, 23, 24, 30, 36, 42, or 48 hours or about 1, 2, 3, 4, 5, 6, 7, 8, 9, 10, 11, 12, 13, 14, 15, 16, 17, 18, 19, 20, 21, 22, 23, 24, 25, 26, 27, or 28 days post-infection. In some embodiments, the sample is a bronchoalveolar lavage (BAL) or a nasal swab (NS). In some embodiments, the sample is a bodily fluid (e.g., blood, e.g., whole blood or plasma) from the subject. In some embodiments, the sample is a tissue sample (e.g., a respiratory tract tissue sample) from the subject. In some embodiments, viral load is a detectible nucleic acid (e.g., subgenomic mRNA) level or a detectible protein (e.g., nucleocapsid protein (N)) level. In some embodiments, the detectible nucleic acid (e.g., subgenomic mRNA) is determined by RNA-seq, RT-qPCR, qPCR, multiplex qPCR or RT-qPCR, LAMP, microarray analysis, or hybridization (e.g., ISH (e.g., FISH)). In some embodiments, the detectible protein (e.g., nucleocapsid protein (N)) is determined by an immunoassay (e.g., an immunohistochemical (IHC) assay or a lateral flow immunoassay). The subject is determined to be responsive to the therapeutic composition if the viral load is below a pre-assigned level. In some embodiments, the pre-assigned level is less than about 3.5 login sgmRNA copies/mL BAL or NS or less than about 5.0 $\log_{10}$ sgmRNA copies/g of tissue (e.g., lung, flares, trachea, heart, GI, spleen, liver, kidney, or brain tissue). In some embodiments, the subject is determined to be responsive to the therapeutic composition if the viral load decreases in the subject.

If the subject is not determined to be responsive as determined by viral load, then the subject may be administered or may be re-administered a coronavirus vaccine composition (e.g., one or more of the therapeutic or immunogenic compositions described herein) alone or in combination with an additional therapeutic agent, such as one or more of the additional therapeutic agents described herein. Administration of a composition of the present disclosure to a subject in need thereof can be performed one or more times (e.g., 1, 2, 3, 4, 5, 6, 7, 8, 9, 10, 11, 12, 13, 14, 15 or more times) over one or more days (e.g., 1, 2, 3, 4, 5, 6, 7, 8, 9, 10, 11, 12, 13, 14, 15, 16, 17, 18, 19, 20, 21, 22, 23, 24, 25, 26, 27, or 28 days) as needed to reduce the viral load.

OTHER EMBODIMENTS

All publications, patents, and patent applications mentioned in this specification are incorporated herein by reference to the same extent as if each independent publication or patent application was specifically and individually indicated to be incorporated by reference.

While the invention has been described in connection with specific embodiments thereof, it will be understood that it is capable of further modifications and this application is intended to cover any variations, uses, or adaptations following, in general, the principles and including such departures from the invention that come within known or customary practice within the art to which the invention pertains and may be applied to the essential features hereinbefore set forth, and follows in the scope of the claims.

The present invention further provides:

Embodiment 1 is an isolated nucleic acid molecule comprising a nucleotide sequence that encodes a 2019-NCOV Spike (S) protein comprising the following modifications to the full-length amino acid sequence of SEQ ID NO: 29:
  a. stabilising mutations to proline at amino acids 986 and 987; and
  b. mutations to the furin cleavage site (SEQ ID NO: 90).

Embodiment 2 is the isolated nucleic acid molecule of embodiment 1 comprising a nucleotide sequence of SEQ ID NO: 211.

Embodiment 3 is the isolated nucleic acid molecule of embodiment 1 or 2 comprising a nucleotide sequence that encodes a 2019-NCOV Spike (S) protein comprising an amino acid sequence of SEQ ID NO: 205.

Embodiment 4 is the isolated nucleic acid molecule of embodiment 1 comprising a nucleotide sequence that encodes a polypeptide having at least 85% sequence identity to an amino acid sequence of SEQ ID NO: 51.

Embodiment 5 is the isolated nucleic acid molecule of embodiment 1 or 4 comprising a nucleotide sequence that encodes a polypeptide having at least 99% sequence identity to an amino acid sequence of SEQ ID NO: 51.

Embodiment 6 is the isolated nucleic acid molecule of embodiment 1 comprising a nucleotide sequence that encodes a polypeptide having at least 85% sequence identity to an amino acid sequence of SEQ ID NO: 54.

Embodiment 7 is the isolated nucleic acid molecule of embodiment 1 comprising a nucleotide sequence that encodes a polypeptide having at least 85% sequence identity to an amino acid sequence of SEQ ID NO: 56.

Embodiment 8 is the isolated nucleic acid molecule of embodiment 1 comprising a nucleotide sequence having at least 85% sequence identity to SEQ ID NO: 121, or a complementary sequence thereof.

Embodiment 9 is the isolated nucleic acid molecule of embodiment 4 or 5 comprising a nucleotide sequence having at least 85% sequence identity to SEQ ID NO: 143, or a complementary sequence thereof.

Embodiment 10 is the isolated nucleic acid molecule of embodiment 6 or 7 comprising a nucleotide sequence having at least 85% sequence identity to SEQ ID NO: 146, or a complementary sequence thereof.

Embodiment 11 is the isolated nucleic acid molecule of embodiment 6 or 7 comprising a nucleotide sequence having at least 85% sequence identity to SEQ ID NO: 148, or a complementary sequence thereof.

Embodiment 12 is the isolated nucleic acid molecule of embodiment 1 that encodes a 2019-NCOV Spike (S) protein comprising the following further modification to the full-length amino acid sequence of SEQ ID NO: 29:
  c. deletion of the signal sequence.

Embodiment 13 is the isolated nucleic acid molecule of embodiment 1 or 12 comprising a nucleotide sequence that encodes a polypeptide having at least 85% sequence identity to an amino acid sequence of SEQ ID NO: 23.

Embodiment 14 is the isolated nucleic acid molecule of embodiment 1, 12 or 13 comprising a nucleotide sequence that encodes a polypeptide having at least 99% sequence identity to an amino acid sequence of SEQ ID NO: 23.

Embodiment 15 is the isolated nucleic acid molecule of embodiment 1 or 12 comprising a nucleotide sequence that encodes a polypeptide having at least 85% sequence identity to an amino acid sequence of SEQ ID NO: 26.

Embodiment 16 is the isolated nucleic acid molecule of embodiment 1, 12 or 13 comprising a nucleotide sequence having at least 85% sequence identity to SEQ ID NO: 115, or a complementary sequence thereof.

Embodiment 17 is the isolated nucleic acid molecule of embodiment 15 comprising a nucleotide sequence having at least 85% sequence identity to SEQ ID NO: 118, or a complementary sequence thereof.

Embodiment 18 is the isolated nucleic acid molecule of any preceding embodiment, wherein the nucleic acid encoding the 2019-NCOV Spike (S) protein is operably linked to a cytomegalovirus (CMV) promoter, preferably the CMV immediate early promoter.

Embodiment 19 is the isolated nucleic acid molecule of any preceding embodiment, wherein the nucleic acid encoding the 2019-NCOV Spike (S) protein is operably linked to a cytomegalovirus (CMV) promoter comprising at least one tetracycline operator (TetO) motif.

Embodiment 20 is the isolated nucleic acid molecule according to embodiment 19, wherein the CMV promoter comprising at least one TetO motif comprises a nucleotide sequence of SEQ ID NO: 219.

Embodiment 21 is the isolated nucleic acid molecule according to embodiment 19 or 20, wherein the CMV promotor consists of the nucleotide sequence of SEQ ID NO: 219.

Embodiment 22 is an isolated 2019-NCOV Spike (S) protein comprising the following modifications to the full-length amino acid sequence of SEQ ID NO: 29:
  a. stabilising mutations to proline at amino acids 986 and 987; and
  b. mutations to the furin cleavage site (SEQ ID NO: 90.

Embodiment 23 is the isolated 2019-NCOV Spike (S) protein of embodiment 22 comprising an amino acid sequence of SEQ ID NO: 205.

Embodiment 24 is the isolated 2019-NCOV Spike (S) protein of embodiment 22 comprising an amino acid sequence having at least 85% sequence identity to an amino acid sequence of SEQ ID NO: 51.

Embodiment 25 is the isolated 2019-NCOV Spike (S) protein of embodiment 22 or 23 comprising an amino acid sequence having at least 99% sequence identity to an amino acid sequence of SEQ ID NO: 51.

Embodiment 26 is the isolated 2019-NCOV Spike (S) protein of embodiment 22 comprising an amino acid sequence having at least 85% sequence identity to an amino acid sequence of SEQ ID NO: 54.

Embodiment 27 is the isolated 2019-NCOV Spike (S) protein of embodiment 22 comprising an amino acid sequence having at least 85% sequence identity to an amino acid sequence of SEQ ID NO: 56.

Embodiment 28 is the isolated 2019-NCOV Spike (S) protein of embodiment 22 comprising the following further modification to the full-length amino acid sequence of SEQ ID NO: 29:
  c. deletion of the signal sequence.

Embodiment 29 is the isolated 2019-NCOV Spike (S) protein of embodiment 22 or 28 comprising an amino acid sequence having at least 85% sequence identity to an amino acid sequence of SEQ ID NO: 23.

Embodiment 30 is the isolated 2019-NCOV Spike (S) protein of embodiment 22, 28 or 29 comprising an amino acid sequence having at least 99% sequence identity to an amino acid sequence of SEQ ID NO: 23.

Embodiment 31 is the isolated 2019-NCOV Spike (S) protein of embodiment 22 or 28 comprising an amino acid sequence having at least 85% sequence identity to an amino acid sequence of SEQ ID NO: 26.

Embodiment 32 is an isolated vector comprising one or more of the nucleic acid molecules of any one of embodiments 1-21.

Embodiment 33 is the vector of embodiment 32, wherein the vector is replication-defective.

Embodiment 34 is the vector of embodiment 32, wherein the vector is a mammalian, bacterial, or viral vector.

Embodiment 35 is the vector of embodiment 32, wherein the vector is an expression vector.

Embodiment 36 is the vector of embodiment 32, wherein the viral vector is a virus selected from the group consisting of a retrovirus, adenovirus, adeno-associated virus, parvovirus, coronavirus, negative strand RNA viruses, orthomyxovirus, rhabdovirus, paramyxovirus, positive strand RNA viruses, picornavirus, alphavirus, double stranded DNA viruses, herpesvirus, Epstein-Barr virus, cytomegalovirus, fowlpox, and canarypox.

Embodiment 37 is the vector of embodiment 36, wherein the vector is an adenovirus.

Embodiment 38 is the vector of embodiment 37, wherein the adenovirus is selected from the group consisting of Ad26, Ad52, Ad59, Ad2, Ad5, Ad11, Ad12, Ad24, Ad34, Ad35, Ad40, Ad48, Ad49, Ad50, and Pan9, in particular Ad26.

Embodiment 39 is a composition comprising the nucleic acid molecule of any one of embodiments 1-21, the polypeptide of any one of embodiments 22-31 or the vector of any one of embodiments 32-38.

Embodiment 40 is the composition of embodiment 39, further comprising a pharmaceutically acceptable carrier, excipient, or diluent.

Embodiment 41 is the composition of embodiment 39 or 40, further comprising an adjuvant or an immunostimulatory agent.

Embodiment 42 is an immunogenic composition comprising the nucleic acid molecule of any one of embodiments 1-21, the polypeptide of any one of embodiments 22-31 or the vector of any one of embodiments 32-38.

Embodiment 43 is the immunogenic composition of embodiment 42, wherein the immunogenic composition is a vaccine.

Embodiment 44 is a composition for use in treating or reducing the risk of a coronavirus infection, such as a 2019-nCoV infection, in a subject in need thereof, comprising a therapeutically effective amount of the composition of any one of embodiments 39-41 or the immunogenic composition of embodiment 42 or 43.

Embodiment 45 is a composition for use in reducing a coronavirus-mediated activity (e.g., 2019-nCoV-mediated activity) in a subject infected with a 2019-nCoV, comprising a therapeutically effective amount of the composition of any one of embodiments 39-41 or the immunogenic composition of embodiment 42 or 43.

Embodiment 46 is a composition for use in prevention of molecularly confirmed, moderate to severe/critical COVID-19 in a subject in need thereof, comprising administering to the subject a composition according to any one of embodiments 39-41 or the immunogenic composition of embodiment 42 or 43, wherein the composition is for administration at a dose of $5 \times 10^{10}$ vp per dose in a one dose regimen.

Embodiment 47 is a method of manufacturing an immunogenic composition for treating or reducing the risk of a coronavirus (e.g., 2019-NCOV) infection in a subject in need thereof, said method comprising the steps of:
(a) admixing at least one of the nucleic acid molecule of any one of embodiments 1-21, the polypeptide of any one of embodiments 22-31, the vector of any one of embodiments 32-38, the composition of any one of embodiments 39-41 with a pharmaceutically acceptable carrier, excipient, or diluent to form the immunogenic composition; and
(b) placing the immunogenic composition in a container.

Embodiment 48 is a kit comprising:
(a) a first container comprising at least one of the nucleic acid molecule of any one of embodiments 1-21, the polypeptide of any one of embodiments 22-31, the vector of any one of embodiments 32-38, the composition of any one of embodiments 39-41, and the immunogenic composition of embodiment 42 or 43;
(b) instructions for use thereof; and optionally
(c) a second container comprising a pharmaceutically acceptable carrier, excipient, or diluent.

Embodiment 49 is the kit of embodiment 48, wherein the first container further comprises a pharmaceutically acceptable carrier, excipient, or diluent.

Embodiment 50 is a kit of embodiment 48 or 49, wherein the kit optionally includes an adjuvant and/or an immunostimulatory agent.

Embodiment 51 is an isolated and/or recombinant nucleic acid encoding a coronavirus S protein comprising a nucleotide sequence of SEQ ID NO: 211, or a fragment thereof.

Embodiment 52 is an isolated and/or recombinant coronavirus S protein comprising an amino acid sequence of SEQ ID NO: 205, or a fragment thereof.

Embodiment 53 is a nucleic acid encoding a coronavirus S protein according to embodiment 52.

Embodiment 54 is the nucleic acid according to embodiment 51 or 53, which is codon optimized for expression in human cells.

Embodiment 55 is a vector comprising a nucleic acid according to embodiment 51, 53, or 54.

Embodiment 56 is a vector comprising a nucleic acid encoding a protein according to embodiment 52.

Embodiment 57 is the vector according to embodiment 55 or 56, wherein the vector is a recombinant human adenoviral vector.

Embodiment 58 is the vector according to embodiment 57, wherein the nucleic acid encoding the coronavirus S protein is operably linked to a cytomegalovirus (CMV) promoter comprising at least one tetracycline operator (TetO) motif.

Embodiment 59 is the vector of embodiment 58, wherein the CMV promoter comprising at least one TetO motif comprises a nucleotide sequence of SEQ ID NO: 219.

Embodiment 60 is the vector according to embodiment 57, 58, or 59, wherein the recombinant human adenovirus has a deletion in the E1 region, a deletion in the E3 region, or a deletion in both the E1 and the E3 region of the adenoviral genome.

Embodiment 61 is the vector according to any one of embodiments 58-60, wherein the vector is a recombinant human adenovirus of serotype 26.

Embodiment 62 is a composition comprising a nucleic acid according to embodiment 51, 53 or 54, a protein according to embodiment 52 and/or a vector according to any one of embodiments 55-61.

Embodiment 63 is a vaccine against COVID-19 comprising a nucleic acid according to any one of the embodiments 51, 53 or 54, a protein according to embodiment 52 and/or a vector according to any one of embodiments 55-61.

Embodiment 64 is the vaccine according to embodiment 63, comprising a recombinant human adenovirus of serotype 26 that comprises nucleic acid encoding a SARS-CoV-2 S protein that comprises the amino acid sequence of SEQ ID NO: 205, or a fragment thereof.

Embodiment 65 is a method for vaccinating a subject against COVID-19, the method comprising administering to the subject a vaccine according to embodiment 63 or 64.

Embodiment 66 is a method for reducing infection and/or replication of SARS-CoV-2 in a subject, comprising administering to the subject a composition according to embodiment 59 or a vaccine according to embodiment 63 or 64.

Embodiment 67 is a method for prevention of molecularly confirmed, moderate to severe/critical COVID-19 in a subject, comprising administering to the subject a vaccine according to embodiment 60 or 61 given in a one or two dose vaccine regimen.

Embodiment 68 is a method for prevention of molecularly confirmed, moderate to severe/critical COVID-19 as compared to placebo, in a SARS-CoV-2 seronegative adult subject, comprising administering to the subject a vaccine according to embodiment 63 or 64 given in a one or two dose vaccine regimen.

Embodiment 69 is a method for reducing SARS-CoV-2 Viral Load as Assessed by Quantitative Reverse-Transcriptase Polymerase Chain Reaction (RT-PCR) in Participants with Molecularly Confirmed, Moderate to Severe/Critical COVID-19 in a subject, comprising administering to the subject a vaccine according to embodiment 63 or 64 given in a one or two dose vaccine regimen.

Embodiment 70 is the method according to any one of embodiments 65-69, wherein the subject is suspected to suffer from or is diagnosed with an infection by SARS-CoV-2.

Embodiment 71 is the method according to any one of embodiments 65-70, wherein the vaccine is administered intramuscularly.

Embodiment 72 is the method according to any one of embodiments 65-71, wherein the vaccine is administered in a two dose vaccine regimen comprising a dose of $5 \times 10^{10}$ vp or $1 \times 10^{11}$ vp per dose given about 8 weeks apart.

Embodiment 73 is the method according to any one of embodiments 65-72, consisting of a single administration of a dose of $5 \times 10^{10}$ vp or $1 \times 10^{11}$ vp per dose of the vaccine to the subject.

Embodiment 74 is an isolated host cell comprising a recombinant human adenovirus of serotype 26 comprising a nucleic acid encoding a SARS-CoV-2 S protein or fragment thereof.

Embodiment 75 is a method for making a vaccine against COVID-19, comprising providing a recombinant human adenovirus of serotype 26 that comprises nucleic acid encoding a SARS-CoV-2 S protein or fragment thereof, propagating said recombinant adenovirus in a culture of host cells, isolating and purifying the recombinant adenovirus, and formulating the recombinant adenovirus in a pharmaceutically acceptable composition.

Embodiment 76 is an isolated recombinant nucleic acid that forms the genome of a recombinant human adenovirus of serotype 26 that comprises nucleic acid encoding a SARS-CoV-2 S protein or fragment thereof.

Embodiment 77 is an isolated nucleic acid molecule comprising a nucleotide sequence that encodes a polypeptide having at least 85% sequence identity to an amino acid sequence of any one of SEQ ID NOs: 1-84.

Embodiment 78 is the nucleic acid molecule of embodiment 77, wherein
a) the polypeptide is capable of eliciting an immune response in a subject; or
b) the polypeptide has at least 86, 87, 88, 89, 90, 91, 92, 93, 94, 95, 96, 97, 98, or 99% sequence identity to, or the polypeptide sequence of, any one of SEQ ID NOs: 1-84.

Embodiment 79 is the nucleic acid molecule of embodiment 77 or 78, wherein the polypeptide has the amino acid sequence of SEQ ID NO: 56.

Embodiment 80 is an isolated nucleic acid molecule comprising a nucleotide sequence having at least 85% sequence identity to all or a portion of any one of SEQ ID NOs: 93-181, 190-195, and 199-204, or a complementary sequence thereof.

Embodiment 81 is the isolated nucleic acid molecule of embodiment 80, wherein said nucleic acid molecule has at least 86, 87, 88, 89, 90, 91, 92, 93, 94, 95, 96, 97, 98, or 99% sequence identity to, or the nucleotide sequence of, any one of SEQ ID NOs: 93-181, 190-195, and 199-204.

Embodiment 82 is the isolated nucleic acid molecule of embodiment 80 or 81, wherein the nucleic acid molecule, or a portion thereof, is capable of eliciting an immune response in a subject.

Embodiment 83 is the isolated nucleic acid molecule of any one of embodiments 80-82, wherein the nucleic acid molecule has the nucleotide sequence of SEQ ID NO: 195.

Embodiment 84 is an isolated polypeptide comprising an amino acid sequence having at least 85% sequence identity to all or a portion of any one of SEQ ID NOs: 1-84.

Embodiment 85 is the isolated polypeptide of embodiment 84, wherein said polypeptide has at least 86, 87, 88, 89, 90, 91, 92, 93, 94, 95, 96, 97, 98, or 99% sequence identity to, or the amino acid sequence of, any one of SEQ ID NOs: 1-84.

Embodiment 86 is the isolated polypeptide of embodiment 84 or 85, wherein the polypeptide, or a portion thereof, is capable of eliciting an immune response in a subject.

Embodiment 87 is the isolated polypeptide of any one of embodiments 84-86, wherein the polypeptide has the amino acid sequence of SEQ ID NO: 28.

Embodiment 88 is an isolated vector comprising one or more of the nucleic acid molecules of any one of embodiments 77-83.

Embodiment 89 is the vector of embodiment 88, wherein the vector is replication-defective.

Embodiment 90 is the vector of embodiment 88 or 89, wherein the vector is a mammalian, bacterial, or viral vector.

Embodiment 91 is the vector of embodiment 90, wherein the vector is an expression vector.

Embodiment 92 is the vector of embodiment 90, wherein the viral vector is a virus selected from the group consisting of a retrovirus, adenovirus, adeno-associated virus, parvovirus, coronavirus, negative strand RNA viruses, orthomyxovirus, rhabdovirus, paramyxovirus, positive strand RNA viruses, picornavirus, alphavirus, double stranded DNA viruses, herpesvirus, Epstein-Barr virus, cytomegalovirus, fowlpox, and canarypox.

Embodiment 93 is the vector of embodiment 92, wherein the vector is an adenovirus.

Embodiment 94 is the vector of embodiment 93, wherein the adenovirus is selected from the group consisting of Ad26, Ad52, Ad59, Ad2, Ad5, Ad11, Ad12, Ad24, Ad34, Ad35, Ad40, Ad48, Ad49, Ad50, and Pan9.

Embodiment 95 is the vector of embodiment 94, wherein the Ad52 is a rhesus Ad52 or the Ad26 is a rhesus Ad26.

Embodiment 96 is an isolated antibody that specifically binds to the polypeptide of any one of embodiments 84-87.

Embodiment 97 is the antibody of embodiment 96, wherein the antibody is generated by immunizing a mammal with the nucleic acid of any one of embodiments 77-82, the polypeptide of any one of embodiments 84-87, or the vector of any one of embodiments 88-95.

Embodiment 98 is the antibody of embodiment 97, wherein the mammal is a human, cow, goat, mouse, or rabbit.

Embodiment 99 is the antibody of embodiments 96 or 97, wherein the antibody is humanized.

Embodiment 100 is the antibody of any one of embodiments 96-99, wherein the antibody is an IgG.

Embodiment 101 is the antibody of any one of embodiments 96-100, wherein the antibody is a bis-Fab, Fv, Fab, Fab'-SH, F(ab')2, a diabody, a linear antibody, or a scFV.

Embodiment 102 is a method of producing an anti-2019-Wuhan coronavirus (2019-nCoV) antibody, comprising administering an amount of the nucleic acid molecule of any one of embodiments 77-83, the polypeptide of any one of embodiments 84-87, and/or the vector of any one of embodiments 88-95 to a subject sufficient to elicit the production of neutralizing anti-2019-nCoV antisera after administration to said subject.

Embodiment 103 is an isolated anti-2019-nCoV antibody produced by the method of embodiment 102.

Embodiment 104 is the antibody of embodiment 103, wherein the antibody binds to an epitope within any one of SEQ ID NOs: 1-84.

Embodiment 105 is a composition comprising the nucleic acid molecule of any one of embodiments 77-83, the polypeptide of any one of embodiments 84-87, the vector of any one of embodiments 88-95 or the antibody of any one of embodiments 96-101 or 103-104.

Embodiment 106 is the composition of embodiment 105, further comprising a pharmaceutically acceptable carrier, excipient, or diluent.

Embodiment 107 is the composition of embodiment 105 or 106, further comprising an adjuvant or an immunostimulatory agent.

Embodiment 108 is an immunogenic composition comprising the nucleic acid molecule of any one of embodiments 77-82, the polypeptide of any one of embodiments 84-87, the vector of any one of embodiments 88-95, or the antibody of any one of embodiments 96-101 or 103-104.

Embodiment 109 is the immunogenic composition of embodiment 108, wherein the immunogenic composition is a vaccine.

Embodiment 110 is the immunogenic composition of embodiment 108, wherein said immunogenic composition is capable of treating or reducing the risk of a coronavirus infection (e.g., a 2019-nCoV infection) in a subject in need thereof.

Embodiment 111 is the immunogenic composition of any one of embodiments 108-110, wherein said immunogenic composition elicits production of neutralizing anti-2019-nCoV antisera after administration to said subject.

Embodiment 112 is the immunogenic composition of any one of embodiments 108-111, wherein the subject is a mammal.

Embodiment 113 is the immunogenic composition of embodiment 112, wherein the mammal is a human.

Embodiment 114 is the immunogenic composition of embodiment 113, wherein the human has an underlying health condition.

Embodiment 115 is the immunogenic composition of embodiment 114, wherein the underlying health condition is hypertension, diabetes, or cardiovascular disease.

Embodiment 116 is a method of identifying, diagnosing, and/or predicting the susceptibility of a subject to a coronavirus infection comprising determining whether the subject has a protective level of an anti-coronavirus antibody (such as an anti-Spike antibody) in a sample from the subject, wherein preferably the protective level is:
  (i) a level that is at or above a titer of at least about 70, as determined using a pseudovirus neutralization assay; or
  (ii) a level that is at or above a titer of at least about 25, as determined using a live virus neutralization assay; or
  (iii) a level that is at least 80% of a median level of an anti-coronavirus antibody in a cohort of convalescent humans, as determined by a pseudovirus neutralization assay or live virus neutralization assay.

Embodiment 117 is the method of embodiment 116, wherein the method further comprises administering an effective amount of the composition of any one of embodiments 105-107 or the immunogenic composition of any one of embodiments 108-115 to the subject having less than a protective level of the anti-coronavirus antibody.

Embodiment 118 is the method of embodiment 116 or 117, wherein the method further comprises identifying a class of the anti-coronavirus antibody (e.g., the anti-Spike antibody).

Embodiment 119 is the method of embodiment 118, wherein the class is IgG.

Embodiment 120 is the method of any one of embodiments 116-119, wherein the sample is a bodily fluid from the subject, wherein preferably the bodily fluid is blood.

Embodiment 121 is the method of any one of embodiments 116-120, wherein the coronavirus is 2019-nCoV.

Embodiment 122 is a method of treating or reducing the risk of a coronavirus infection in a subject in need thereof, comprising administering a therapeutically effective amount of the composition of any one of embodiments 105-107 or the immunogenic composition of any one of embodiments 108-115 to said subject.

Embodiment 123 is the method of embodiment 122, further comprising measuring an anti-coronavirus antibody (e.g., an anti-Spike antibody) level in the subject.

Embodiment 124 is the method of embodiment 123, wherein the anti-coronavirus antibody level in the subject is measured before and/or after the administration.

Embodiment 125 is the method of embodiment 124, wherein the anti-coronavirus antibody level in the subject is measured one or more times over about 1, 2, 3, 4, 5, or 6 days, 1, 2, 3, 4, 5, 6, or 7 weeks, 2, 3, 4, 5, or 6 months, 1, 2, 3, 4, or 5 years after administration.

Embodiment 126 is the method of any one of embodiments 122-125, wherein the anti-coronavirus antibody level of the subject is below a protective level and wherein the method further comprises re-administering the composition of any one of embodiments 105-107 or the immunogenic composition of any one of embodiments 108-115 to said subject or administering a different anti-coronavirus composition to the subject.

Embodiment 127 is the method of embodiment 126, wherein the protective level is a level sufficient to reduce symptoms or duration of a coronavirus-mediated disease.

Embodiment 128 is the method of embodiment 126 or 127, wherein the protective level is:
  (i) a level that is at or above a titer of at least about 70, as determined using a pseudovirus neutralization assay; or
  (ii) a level that is at or above a titer of at least about 25, as determined using a live virus neutralization assay; or
  (iii) a level that is at least 80% of a median level of an anti-coronavirus antibody in a cohort of convalescent humans, as determined by a pseudovirus neutralization assay or live virus neutralization assay.

Embodiment 129 is the method of any one of embodiments 122-128, wherein the coronavirus is 2019-nCoV.

Embodiment 130 is a method of reducing a coronavirus-mediated activity (e.g., 2019-nCoV-mediated activity) in a subject infected with a 2019-nCoV, comprising administering a therapeutically effective amount of the composition of any one of embodiments 105-107 or the immunogenic composition of any one of embodiments 108-115 to said subject.

Embodiment 131 is the method of embodiment 130, wherein the therapeutically effective amount is sufficient to produce a log serum anti-Spike antibody titer greater than 2 in a subject, as measured by an ELISA assay.

Embodiment 132 is the method of embodiment 131, wherein the therapeutically effective amount is between 15 pg and 300 pg of the composition of any one of embodiments 105-107 or the immunogenic composition of any one of embodiments 108-115.

Embodiment 133 is the method of any one of embodiments 130-132, wherein said activity is viral titer, viral spread, infection, or cell fusion.

Embodiment 134 is the method of embodiment 133, wherein said viral titer is decreased after administration of the composition of any one of embodiments 105-107 or the immunogenic composition of any one of embodiments 108-115.

Embodiment 135 is the method of embodiment 134, wherein the viral titer is decreased by 25% or more.

Embodiment 136 is the method of embodiment 135, wherein the viral titer is decreased by 50% or more.

Embodiment 137 is the method of embodiment 136, wherein the viral titer is decreased by 75% or more.

Embodiment 138 is the method of embodiment 137, wherein the coronavirus is undetectable after said administration.

Embodiment 139 is the method of any one of embodiments 130-138, wherein said administering occurs prior to exposure to the coronavirus.

Embodiment 140 is the method of embodiment 139, wherein said administering occurs at least 1 hour prior to exposure to said coronavirus.

Embodiment 141 is the method of embodiment 140, wherein said administering occurs at least 1 week, 1 month, or a year prior to exposure to said coronavirus.

Embodiment 142 is the method of any one of embodiments 130-138, wherein said administering occurs post-exposure to the coronavirus.

Embodiment 143 is the method of embodiment 142, wherein said administering occurs at least 15 minutes post-exposure to said coronavirus.

Embodiment 144 is the method of embodiment 143, wherein said administering occurs at least 1 hour, 1 day, 1 week, post-exposure to said coronavirus.

Embodiment 145 is the method of any one of embodiments 130-144, wherein said subject is administered at least one dose of the nucleic acid molecule, polypeptide, vector, composition, immunogenic composition, and antibody.

Embodiment 146 is the method of embodiment 145, wherein said subject is administered at least two doses.

Embodiment 147 is the method of embodiment 146, wherein said nucleic acid molecule, polypeptide, vector, composition, or immunogenic composition is administered to said subject as a prime, a boost, or as a prime-boost.

Embodiment 148 is the method of any one of embodiments 130-147, wherein the nucleic acid molecule, polypeptide, vector, composition, immunogenic composition, or antibody is administered intramuscularly, intravenously, intradermally, percutaneously, intraarterially, intraperitoneally, intralesionally, intracranially, intraarticularly, intraprostatically, intrapleurally, intratracheally, intranasally, intravitreally, intravaginally, intrarectally, topically, intratumorally, peritoneally, subcutaneously, subconjunctively, intravesicularlly, mucosally, intrapericardially, intraumbilically, intraocularly, orally, topically, locally, by inhalation, by injection, by infusion, by continuous infusion, by localized perfusion bathing target cells directly, by catheter, by lavage, by gavage, in creams, or in lipid compositions.

Embodiment 149 is the method of any one of embodiments 130-148, wherein the subject is a mammal.

Embodiment 150 is the method of embodiment 149, wherein the mammal is a human.

Embodiment 151 is the method of embodiment 150, wherein the human has an underlying health condition.

Embodiment 152 is the method of embodiment 151, wherein the underlying health condition is hypertension, diabetes, or cardiovascular disease.

Embodiment 153 is the method of any one of embodiments 130-152, wherein the method promotes an immune response in said subject.

Embodiment 154 is the method of embodiment 153, wherein the immune response is a humoral immune response.

Embodiment 155 is the method of embodiment 154, wherein the humoral immune response is an IgG response.

Embodiment 156 is a composition for use in treating or reducing the risk of a coronavirus infection, such as a 2019-nCoV infection, in a subject in need thereof, comprising a therapeutically effective amount of the composition of any one of embodiments 105-107 or the immunogenic composition of any one of embodiments 108-115.

Embodiment 157 is a composition for use in reducing a coronavirus-mediated activity (e.g., 2019-nCoV-mediated activity) in a subject infected with a 2019-nCoV, comprising a therapeutically effective amount of the composition of any one of embodiments 105-107 or the immunogenic composition of any one of embodiments 108-115.

Embodiment 158 is a method of manufacturing an immunogenic composition for treating or reducing the risk of a coronavirus (e.g., 2019-nCoV) infection in a subject in need thereof, said method comprising the steps of:
(a) admixing at least one of the nucleic acid molecule of any one of embodiments 77-83, the polypeptide of any one of embodiments 84-87, the vector of any one of embodiments 88-95, the composition of any one of embodiments 105-107, and the antibody of any one of embodiments 96-101 or 102-104 with a pharmaceutically acceptable carrier, excipient, or diluent to form the immunogenic composition; and
(b) placing the immunogenic composition in a container.

Embodiment 159 is a kit comprising:
(a) a first container comprising at least one of the nucleic acid molecule of any one of embodiments 77-83, the polypeptide of any one of embodiments 84-87, the vector of any one of embodiments 88-95, the composition of any one of embodiments 105-107, the immunogenic composition of any one of embodiments 108-115, and the antibody of any one of embodiments 96-101 or 103-104;
(b) instructions for use thereof; and optionally
(c) a second container comprising a pharmaceutically acceptable carrier, excipient, or diluent.

Embodiment 160 is the kit of embodiment 159, wherein the first container further comprises a pharmaceutically acceptable carrier, excipient, or diluent.

Embodiment 161 is a kit of embodiment 159 or 160, wherein the kit optionally includes an adjuvant and/or an immunostimulatory agent.

Embodiment 162 is the isolated nucleic acid molecule of any one of embodiments 80-82, wherein the nucleic acid molecule has the nucleotide sequence of SEQ ID NO: 143.

Embodiment 163 is the isolated nucleic acid molecule of any one of embodiments 80-82, wherein the nucleic acid molecule has the nucleotide sequence of SEQ ID NO: 204.

Embodiment 164 is the isolated nucleic acid molecule of any one of embodiments 80-82, wherein the nucleic acid molecule has the nucleotide sequence of nucleotides 19-3837 of SEQ ID NO: 204.

Embodiment 165 is the isolated polypeptide of any one of embodiments 84-86, wherein the polypeptide has the amino acid sequence of SEQ ID NO: 51.

Embodiment 166 is the vector of embodiment 88, wherein the vector is Ad26.

Embodiment 167 is the antibody of embodiment 93, wherein the antibody is generated by immunizing a mammal with a nucleic acid comprising SEQ ID NO: 143, nucleotides 19-3837 of SEQ ID NO: 204 or SEQ ID NO: 204, a polypeptide comprising the amino acid sequence of SEQ ID NO: 51, or an Ad26 vector comprising a nucleic acid comprising SEQ ID NO: 143, nucleotides 19-3837 of SEQ ID NO: 204 or SEQ ID NO: 204.

Embodiment 168 is the method of embodiment 102, comprising administering an amount of a nucleic acid molecule comprising SEQ ID NO: 143, nucleotides 19-3837 of SEQ ID NO: 204 or SEQ ID NO: 204, a polypeptide comprising the amino acid sequence of SEQ ID NO: 51, or an Ad26 vector comprising a nucleic acid comprising SEQ ID NO: 143, nucleotides 19-3837 of SEQ ID NO: 204 or SEQ ID NO: 204 to a subject sufficient to elicit the production of neutralizing anti-2019-nCoV antisera after administration to said subject.

Embodiment 169 is a composition comprising the nucleic acid molecule of any one of embodiments 162-164, the polypeptide of embodiment 165, the vector of embodiment 166 or the antibody of embodiments 167 or 168.

Embodiment 170 is an immunogenic composition comprising the nucleic acid molecule of any one of embodiments 162-164, the polypeptide of embodiment 165, the vector of embodiment 166 or the antibody of embodiments 167 or 168.

Embodiment 171 is a method of treating or reducing the risk of a coronavirus infection in a subject in need thereof, comprising administering a therapeutically effective amount of the composition of embodiment 169 or the immunogenic composition of embodiment 170 to said subject.

Embodiment 172 is a method of reducing a coronavirus-mediated activity (e.g., 2019-nCoV-mediated activity) in a subject infected with a 2019-nCoV, comprising administering a therapeutically effective amount of the composition of embodiment 169 or the immunogenic composition of embodiment 170 to said subject.

Embodiment 173 is a composition for use in treating or reducing the risk of a coronavirus infection, such as a 2019-nCoV infection, in a subject in need thereof, comprising a therapeutically effective amount of the composition of embodiment 169 or the immunogenic composition of embodiment 170.

Embodiment 174 is a composition for use in reducing a coronavirus-mediated activity (e.g., 2019-nCoV-mediated activity) in a subject infected with a 2019-nCoV, comprising a therapeutically effective amount of the composition of embodiment 169 or the immunogenic composition of embodiment 170.

Embodiment 175 is the use of at least one of the nucleic acid molecule of any one of embodiments 1-21, the polypeptide of any one of embodiments 22-31, the vector of any one of embodiments 32-38, the composition of any one of embodiments 39-41, and the immunogenic composition of embodiment 42 or 43, in the preparation of a medicament for the treatment, or reduction of the risk, of a coronavirus infection, such as a 2019-nCoV infection, in a subject in need thereof.

Embodiment 176 is the use of at least one of the nucleic acid molecule of any one of embodiments 1-21, the polypeptide of any one of embodiments 22-31, the vector of any one of embodiments 32-38, the composition of any one of embodiments 39-41, and the immunogenic composition of embodiment 42 or 43, in the preparation of a medicament for the reduction of a coronavirus-mediated activity (e.g., 2019-nCoV-mediated activity) in a subject infected with a 2019-nCoV.

Embodiment 177 is the use of at least one of the nucleic acid molecule of any one of embodiments 1-21, the polypeptide of any one of embodiments 22-31, the vector of any one of embodiments 32-38, the composition of any one of embodiments 39-41, and the immunogenic composition of embodiment 42 or 43, in the preparation of a medicament for the prevention of molecularly confirmed, moderate to severe/critical COVID-19 in a subject in need thereof, wherein the composition is for administration at a dose of 5×1010 vp per dose in a one dose regimen.

Embodiment 178 is the vaccine according to embodiment 63 or 64, for use in vaccinating a subject against COVID-19.

Embodiment 179 is the vaccine according to embodiment 63 or 64 or the composition of embodiment 62, for use in reducing infection and/or replication of SARS-CoV-2 in a subject.

Embodiment 180 is the vaccine according to embodiment 64 or 64, for use in the prevention of molecularly confirmed, moderate to severe/critical COVID-19 in a subject, in a one or two dose vaccine regimen.

Embodiment 181 is the vaccine according to embodiment 63 or 64, for use in the prevention of molecularly confirmed, moderate to severe/critical COVID-19 as compared to placebo, in SARS-CoV-2 seronegative adult subjects, in a one or two dose vaccine regimen.

Embodiment 182 is the vaccine according to embodiment 63 or 64, for use in reducing SARS-CoV-2 Viral Load as Assessed by Quantitative Reverse-Transcriptase Polymerase Chain Reaction (RT-PCR) in Participants with Molecularly Confirmed, Moderate to Severe/Critical COVID-19 in a subject, in a one or two dose vaccine regimen.

Embodiment 183 is the vaccine for use according to any one of the embodiments 178-182, wherein the subject is suspected to suffer from or is diagnosed with an infection by SARS-CoV2.

Embodiment 184 is the vaccine for use according to any one of the embodiments 178-183, wherein the vaccine is formulated for intramuscular administration.

Embodiment 185 is the vaccine for use according to any one of the embodiments 181-184, wherein the vaccine is for administration in a two dose vaccine regimen comprising a dose of $5\times10^{10}$ vp or $1\times10^{11}$ vp per dose given about 8 weeks apart.

Embodiment 186 is the vaccine for use according to any one of the embodiments 178-185, consisting of a single administration of a dose of $5\times10^{10}$ vp or $1\times10^{11}$ vp per dose of the vaccine to the subject.

Embodiment 187 is the use of the nucleic acid according to any one of the embodiments 51, 53 or 54, the protein according to embodiment 52 and/or the vector according to any one of embodiments 55-61, in the preparation of a medicament for vaccinating a subject against COVID-19.

Embodiment 188 is the use of the nucleic acid according to any one of the embodiments 51, 53 or 54, the protein according to embodiment 52 and/or the vector according to any one of embodiments 55-61, in the preparation of a medicament for reducing infection and/or replication of SARS-CoV-2 in a subject.

Embodiment 189 is the use of the nucleic acid according to any one of the embodiments 51, 53 or 54, the protein according to embodiment 52 and/or the vector according to any one of embodiments 55-61, in the preparation of a medicament for the prevention of molecularly confirmed, moderate to severe/critical COVID-19 in a subject, in a one or two dose vaccine regimen.

Embodiment 190 is the use of the nucleic acid according to any one of the embodiments 51, 53 or 54, the protein according to embodiment 52 and/or the vector according to any one of embodiments 55-61, in the preparation of a medicament for the prevention of molecularly confirmed, moderate to severe/critical COVID-19 as compared to placebo, in SARS-CoV-2 seronegative adult subjects, in a one or two dose vaccine regimen.

Embodiment 191 is the use of the nucleic acid according to any one of the embodiments 51, 53 or 54, the protein according to embodiment 52 and/or the vector according to any one of embodiments 55-61, in the preparation of a medicament for reducing SARS-CoV-2 Viral Load as Assessed by Quantitative Reverse-Transcriptase Polymerase Chain Reaction (RT-PCR) in Participants with Molecularly Confirmed, Moderate to Severe/Critical COVID-19 in a subject, in a one or two dose vaccine regimen.

Embodiment 192 is the use according to any one of the embodiments 187-191, wherein the subject is suspected to suffer from or is diagnosed with an infection by SARS-CoV2.

Embodiment 193 is the use according to any one of the embodiments 187-192, wherein the vaccine is formulated for intramuscular administration.

Embodiment 194 is the use according to any one of the embodiments 187-193, wherein the vaccine is for administration in a two dose vaccine regimen comprising a dose of $5 \times 10^{10}$ vp or $1 \times 10^{11}$ vp per dose given about 8 weeks apart.

Embodiment 195 is the use according to any one of the embodiments 187-194, for a single administration of a dose of $5 \times 10^{10}$ vp or $1 \times 10^{11}$ vp per dose of the vaccine to the subject.

Embodiment 196 is the use of the nucleic acid molecule of any one of embodiments 77-83, the polypeptide of any one of embodiments 84-87, the vector of any one of embodiments 88-95 or the antibody of any one of embodiments 96-101 or 103-104, in the preparation of a medicament for treating or reducing the risk of a coronavirus infection, such as a 2019-nCoV infection, in a subject in need thereof.

Embodiment 197 is the use of the nucleic acid molecule of any one of embodiments 77-83, the polypeptide of any one of embodiments 84-87, the vector of any one of embodiments 88-95 or the antibody of any one of embodiments 99-101 or 103-104, in the preparation of a medicament for reducing a coronavirus-mediated activity (e.g., 2019-nCoV-mediated activity) in a subject infected with a 2019-nCoV.

Embodiment 198 is the use of the nucleic acid molecule of any one of embodiments 162-164, the polypeptide of embodiment 165, the vector of embodiment 166 or the antibody of embodiments 167 or 168 in the preparation of a medicament for treating or reducing the risk of a coronavirus infection, such as a 2019-nCoV infection, in a subject in need thereof.

Embodiment 199 is the use of the nucleic acid molecule of any one of embodiments 162-164, the polypeptide of embodiment 165, the vector of embodiment 166 or the antibody of embodiments 167 or 168 in the preparation of a medicament for reducing a coronavirus-mediated activity (e.g., 2019-nCoV-mediated activity) in a subject infected with a 2019-nCoV. Particular embodiments are within the embodiments.

The invention is further explained in the following examples. The examples do not limit the invention in any way. They merely serve to clarify the invention.

EXAMPLES

The following examples are to illustrate the invention. They are not meant to limit the invention in any way.

Example 1. Development of 2019-nCoV DNA Vaccines

Design of 2019-nCoV Immunogens and 2019-nCoV DNA Vaccines

Wuhan coronavirus (2019-nCoV) Spike protein (SEQ ID NO: 29) was used to design nucleic acid molecules (SEQ ID NOs: 93-181, 190-195, and 199-204) for synthetic production. Some optimization of the nucleic acid molecules was performed for enhanced transgene expression. DNA vaccines can be generated by incorporating a nucleic acid molecule of SEQ ID NOs: 93-181, 190-195, and 199-204 into a mammalian expression vector (e.g., pcDNA3.1+; Invitrogen, CA, USA). Deletion mutants may lack the signal sequence, the cytoplasmic region, the transmembrane region, S2, or a combination thereof.

Example 2. Administration of a Nucleic Acid Vaccine to a Human Subject

Compositions may be administered to human subjects, pre- or post-exposure to a 2019-nCoV, according to the methods. The human subject may be one identified as being at high risk for infection, such as an individual who has or will be traveling to a region where 2019-nCoV infection is prevalent (e.g., Hubei province), or identified as presenting with symptoms consistent with a 2019-nCoV infection.

For example, a human with underlying health conditions (e.g., hypertension, diabetes, or cardiovascular disease) identified as having a risk of 2019-nCoV infection may be administered a nucleic acid vaccine (e.g., a DNA vaccine or an RNA vaccine) containing a nucleic acid molecule encoding a 2019-nCoV nucleic acid (e.g., any one of SEQ ID NOs: 93-181, 190-195, and 199-204)), e.g., in an adenoviral vector at a dose of between 10 pg and 10 mg. Preferably, the nucleic acid vaccine (e.g., a DNA vaccine or an RNA vaccine) can contains SEQ ID NOs: 136, 193, 142, 148, 195, 121, 122, 123, 129, and/or 130. The patient can then be monitored for presentation of symptoms of 2019-nCoV infection, the resolution of symptoms, and/or the production of 2019-nCoV antibodies. If necessary, a second dose or additional doses of the nucleic acid vaccine can be administered.

Example 3. Administration of an Immunogenic 2019-nCoV Polypeptide to a Human Subject Compositions may be administered to human subjects, pre- or post-exposure to a 2019-nCoV, according to the methods. The human subject may be one identified as being at high risk for infection, such as an individual who has or will be traveling to a region where 2019-nCoV infection is prevalent (e.g., Hubei province), or identified as presenting with symptoms consistent with a 2019-nCoV infection.

For example, a human with underlying health conditions (e.g., hypertension, diabetes, or cardiovascular disease) identified as having a risk of 2019-nCoV infection may be administered a 2019-nCoV immunogen (e.g., any one of SEQ ID NOs: 1-84), e.g., in an adenoviral vector at a dose of between 10 pg and 10 mg. Preferably, the immunogen is a one or more polypeptides encoded by SEQ ID NOs: 44, 50, 56, 29, 30, 31, 37, or 38. The patient can then be monitored for presentation of symptoms of 2019-nCoV infection, the resolution of symptoms, and/or the production of 2019-nCoV antibodies. If necessary, a second dose or additional doses of the immunogen can be administered.

Example 4. Administration of Anti-2019-nCoV Antibodies to a Human Subject at Risk of 2019-nCoV Infection A human subject identified as having a risk of 2019-nCoV infection (e.g., due to travel to a region where 2019-nCoV infection is prevalent (e.g., Hubei province), or the subject being a human with underlying health conditions (e.g., hypertension, diabetes, or cardiovascular disease)) may be administered an anti-2019-nCoV antibody that binds to an epitope within the Spike (SEQ ID NO: 29) polypeptide (e.g., the antibody may have been generated against the polypeptides of any one of SEQ ID NOs: 1-84) at a dose of between 1-1,000 mg as a prophylactic therapy. The subject may be administered the anti-2019-nCoV antibody as a prophylactic therapy prior to or post-exposure to a 2019-nCoV. The patient can then be monitored for presentation of symptoms of 2019-nCoV infection or the resolution of symptoms. If necessary, a second dose or additional doses of the anti-2019-nCoV antibody can be administered.

Example 5. Administration of Anti-2019-nCoV Antibodies to a Human Subject Presenting Symptoms of 2019-nCoV Infection A human subject identified as presenting symptoms of 2019-nCoV may be administered an anti-2019-nCoV antibody that binds to an epitope within the Spike (SEQ ID NO: 29) polypeptide (e.g., the antibody may have been generated against the polypeptides of any one of SEQ ID NOs: 1-84) at a dose of between 1-1,000 mg. The subject (e.g., a human, in particular a human with underlying health conditions (e.g., hypertension, diabetes, or cardiovascular disease)) may have recently traveled to a region where 2019-nCoV infection is prevalent (e.g., Hubei province). After diagnosis of 2019-nCoV infection by a medical practitioner, the subject can be administered a dose of the anti-2019-nCoV antibody. The patient can then be monitored for resolution of symptoms. If necessary, a second dose or additional doses of the anti-2019-nCoV antibody can be administered.

Figure 2:
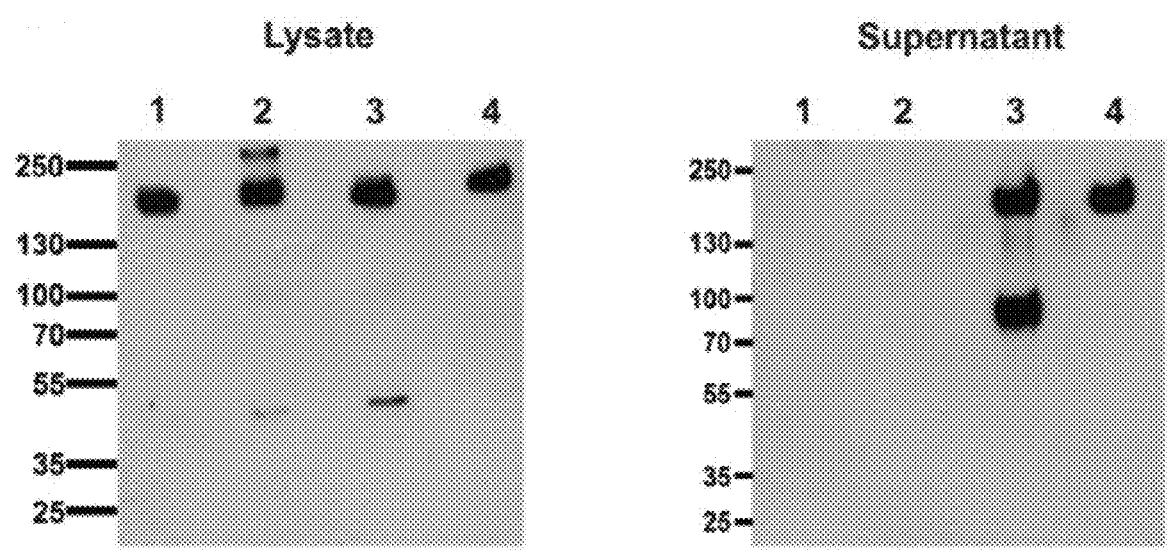
FIG. 2 is a western blot showing the recognition of recombinant 2019-nCoV proteins by polyclonal anti-SARS antiserum. Cell lysates (left panel) and supernatants (right panel) from cells transfected with DNA encoding SS-Spike (lane 1), SS-SdCT (lane 2), SS-S.Ecto (lane 3), and SS-S.Ecto-dF-PP-foldon (lane 4) were probed using polyclonal anti-SARS antiserum. Numbered black lines to the left of each blot indicate approximate molecular weight in kDa and numbers at the top of each blot indicate lane number.

Example 6. Reactivity of Immunogens Encoded by 2019-nCoV DNA Vaccines with Polyclonal Anti-SARS Antiserum In order to assess the reactivity of the immunogens encoded by 2019-nCoV DNA vaccines with anti-SARS antibodies, cells were transfected with plasmids containing SS-Spike (SEQ ID NO: 121), SS-SdCT (SEQ ID NO: 122), SS-S.Ecto (SEQ ID NO: 123), and SS-S.Ecto-dF-PP-foldon (SEQ ID NO: 195) encoding 2019-nCoV immunogens (SEQ ID NOs: 29, 30, 31, and 56, respectively). Cell lysates and supernatants were collected from transfected cells and run on a gel under reducing and denaturing conditions. The samples were subsequently analyzed by western blot using polyclonal anti-SARS antiserum (BEI Resources, NIAID, NIH; catalog number: NR-10361) isolated from guinea pigs. All DNA vaccines tested were able produce proteins that cross-react with anti-SARS antibodies present in the antiserum (FIG. 2). The Spike protein appears as a band with a size of approximately 200 kDa.

Figure 3:
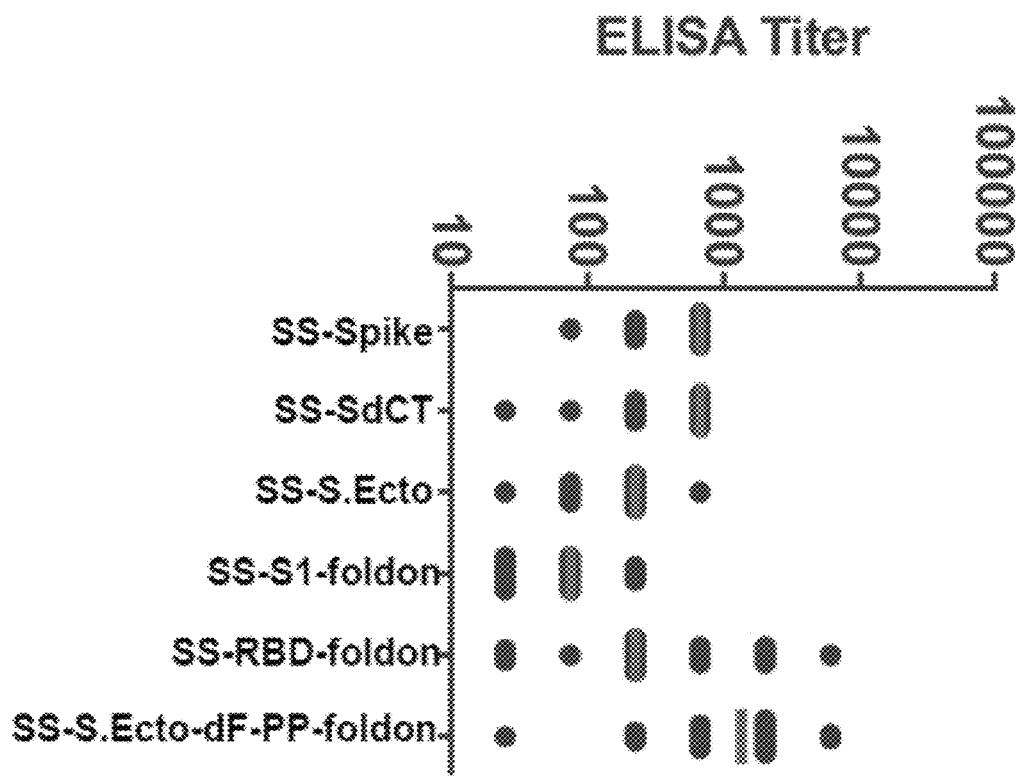
FIG. 3 is a graph showing the recognition of full-length Spike by antibodies produced in 2019-nCoV vaccinated mice. Serum was collected from mice 4-weeks post-vaccination with DNA encoding SS-Spike (lane 1), SS-SdCT (lane 2), SS-S.Ecto (lane 3), SS-S1-foldon (lane 4), SS-RBD-foldon (lane 5), and SS-S.Ecto-dF-PP-foldon (lane 6) and used in an ELISA with full-length Spike (SEQ ID NO: 1). Gray bars represent mean ELISA titer.
Figure 4:
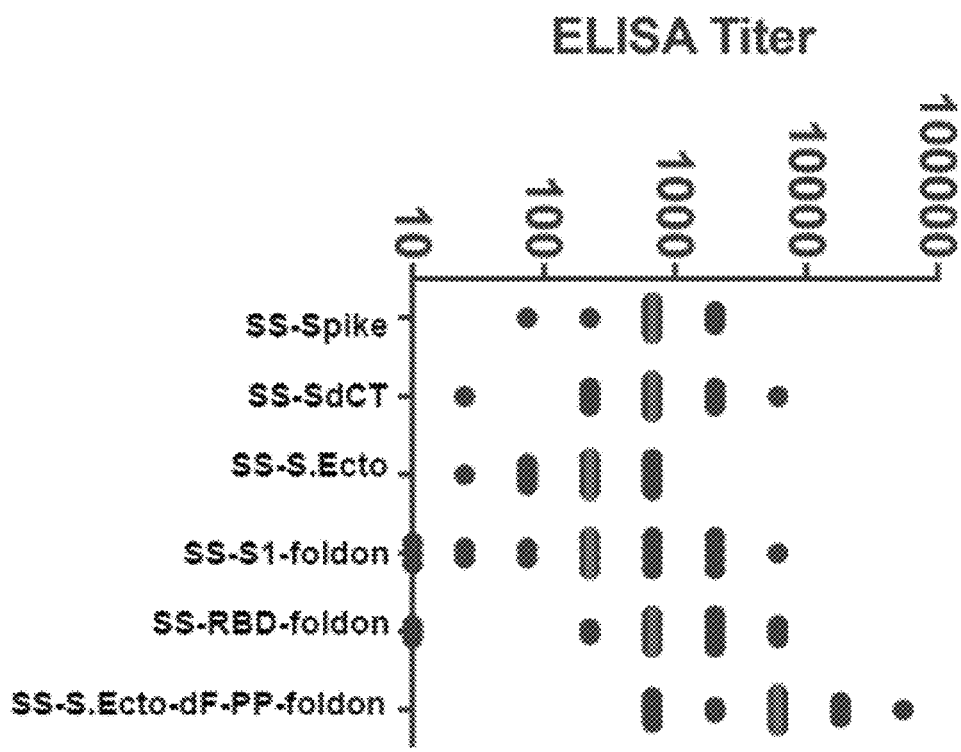
FIG. 4 is a graph showing the recognition of S.dTM.PP by antibodies produced in 2019-nCoV vaccinated mice. Serum was collected from mice 4-weeks post-vaccination with DNA encoding SS-Spike (lane 1), SS-SdCT (lane 2), SS-S.Ecto (lane 3), SS-S1-foldon (lane 4), SS-RBD-foldon (lane 5), and SS-S.Ecto-dF-PP-foldon (lane 6) and used in an ELISA with full-length ectodomain S.Ecto-PP (SEQ ID NO: 19). Gray bars represent mean ELISA titer.

Example 7. 2019-nCoV DNA Vaccines are Able to Elicit a Neutralizing Anti-Spike Antibody Response DNA vaccines containing SS-Spike (SEQ ID NO: 121), SS-SdCT (SEQ ID NO: 122), SS-S.Ecto (SEQ ID NO: 123), SS-S1-foldon (SEQ ID NO: 129), SS-RBD-foldon (SEQ ID NO: 130), and SS-S.Ecto-dF-PP-foldon (SEQ ID NO: 195) encoding 2019-nCoV immunogens (SEQ ID NOs: 29, 30, 31, 37, 38, and 56, respectively) were tested for their ability to produce a neutralizing antibody response. Female Balb/c mice (8-12 weeks old) were intramuscularly (IM) injected with 50 pg of one of the DNA vaccines and a second dose was injected IM four weeks later. Serum samples from the treated mice were collected 4-weeks post-vaccination and analyzed by ELISA for binding to full-length Spike (SEQ ID NO: 1) (FIG. 3) and S.Ecto-PP (SEQ ID NO: 19) (FIG. 4). All of the DNA vaccines tested were able to elicit an antibody response that recognizes full-length Spike (SEQ ID NO: 1) and S.Ecto-PP (SEQ ID NO: 19) in the treated mice. The DNA vaccine encoding SS-S.Ecto-dF-PP-foldon produced a superior antibody response as compared to the other DNA vaccines tested.

Figure 5:
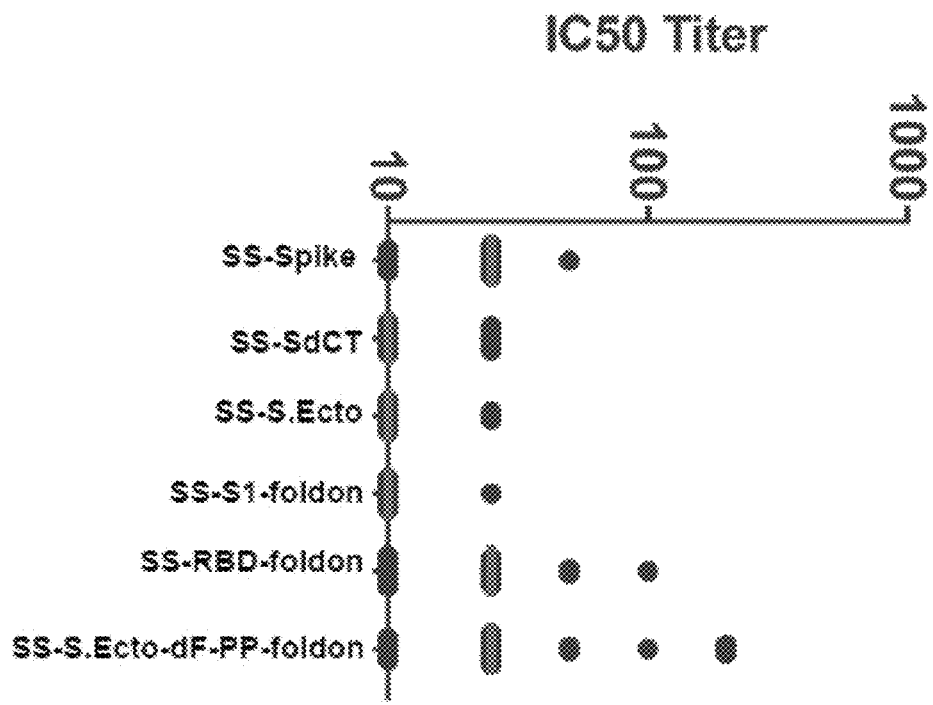
FIG. 5 is a graph showing the neutralizing activity of antibodies produced in 2019-nCoV vaccinated mice. Serum was collected from mice 4-weeks post-vaccination with DNA encoding SS-Spike (lane 1), SS-SdCT (lane 2), SS-S.Ecto (lane 3), SS-S1-foldon (lane 4), SS-RBD-foldon (lane 5), and SS-S.Ecto-dF-PP-foldon (lane 6) and used in an in vitro 2019-nCoV Spike pseudovirus neutralization assay. Gray bars represent mean IC50 titer.
Figure 6A:
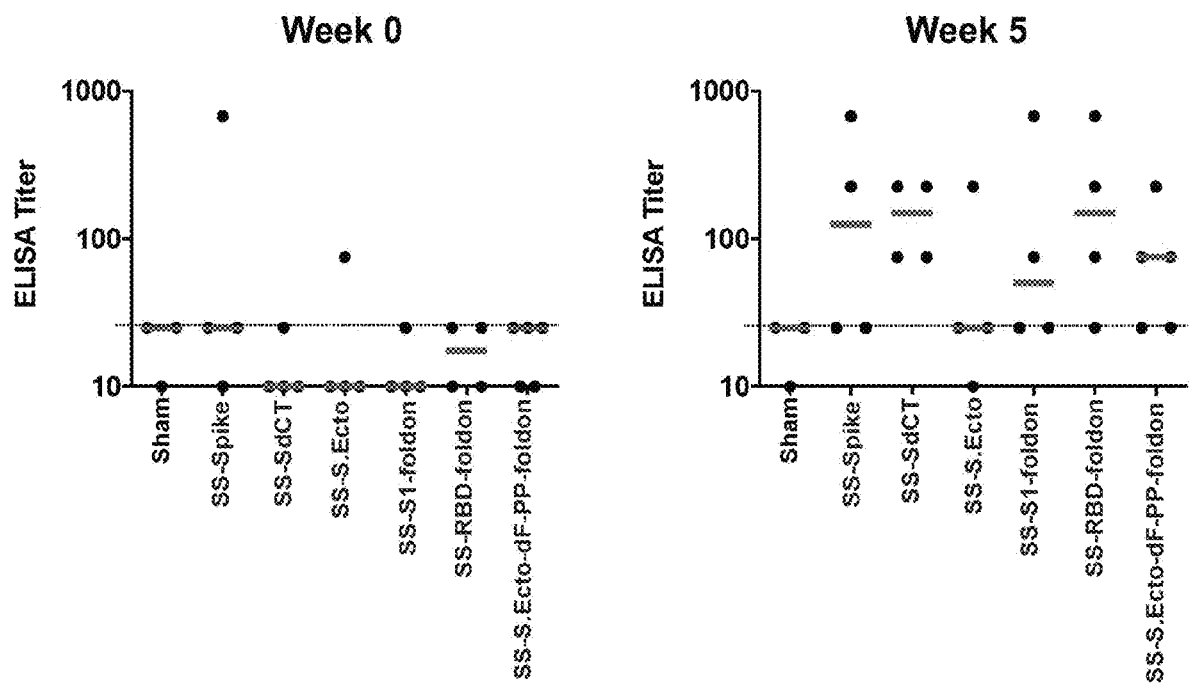
FIGS. 6A-6E are graphs showing humoral immune responses in vaccinated rhesus macaques. Humoral immune responses were assessed following immunization by (FIG. 6A) binding antibody ELISA, (FIG. 6B) pseudovirus neutralization assays, and (FIG. 6C) live virus neutralization assays.
Figure 6B:
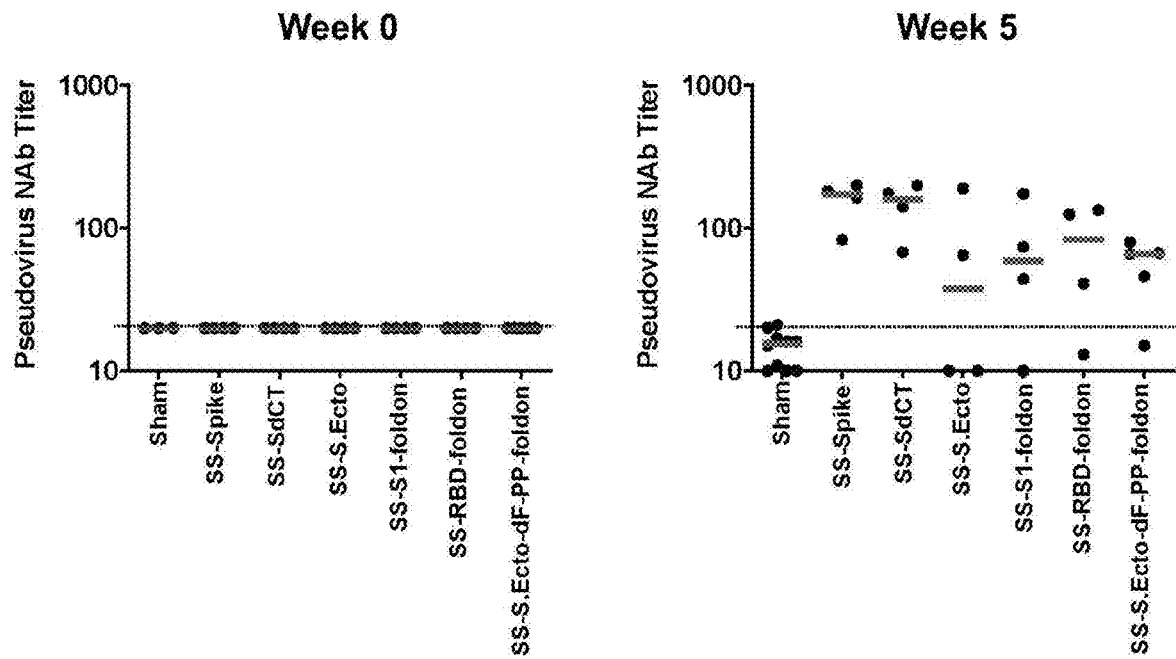
Figure 6C:
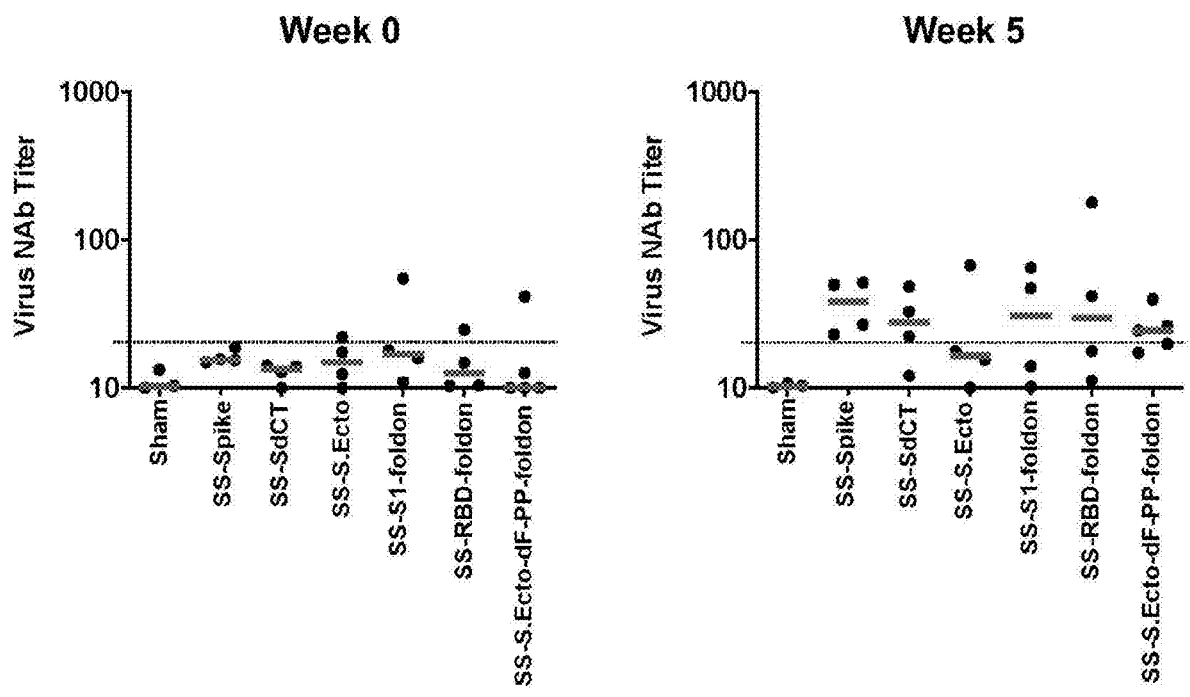
Figure 6D:
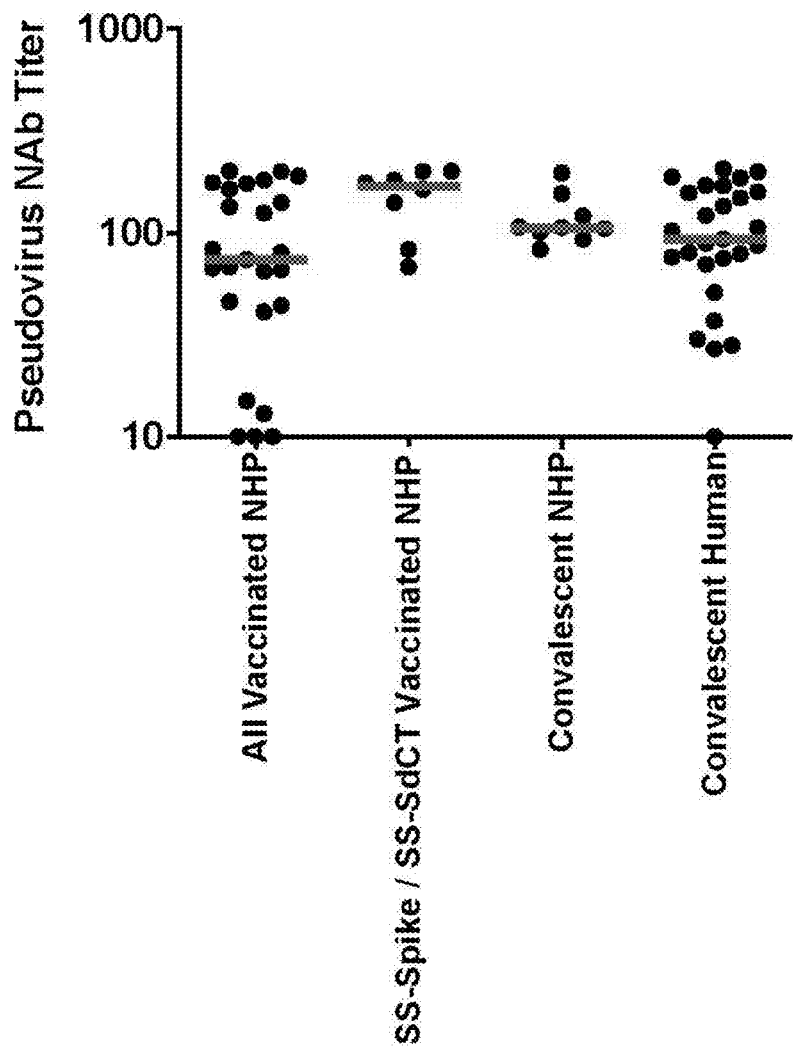
Figure 6E:
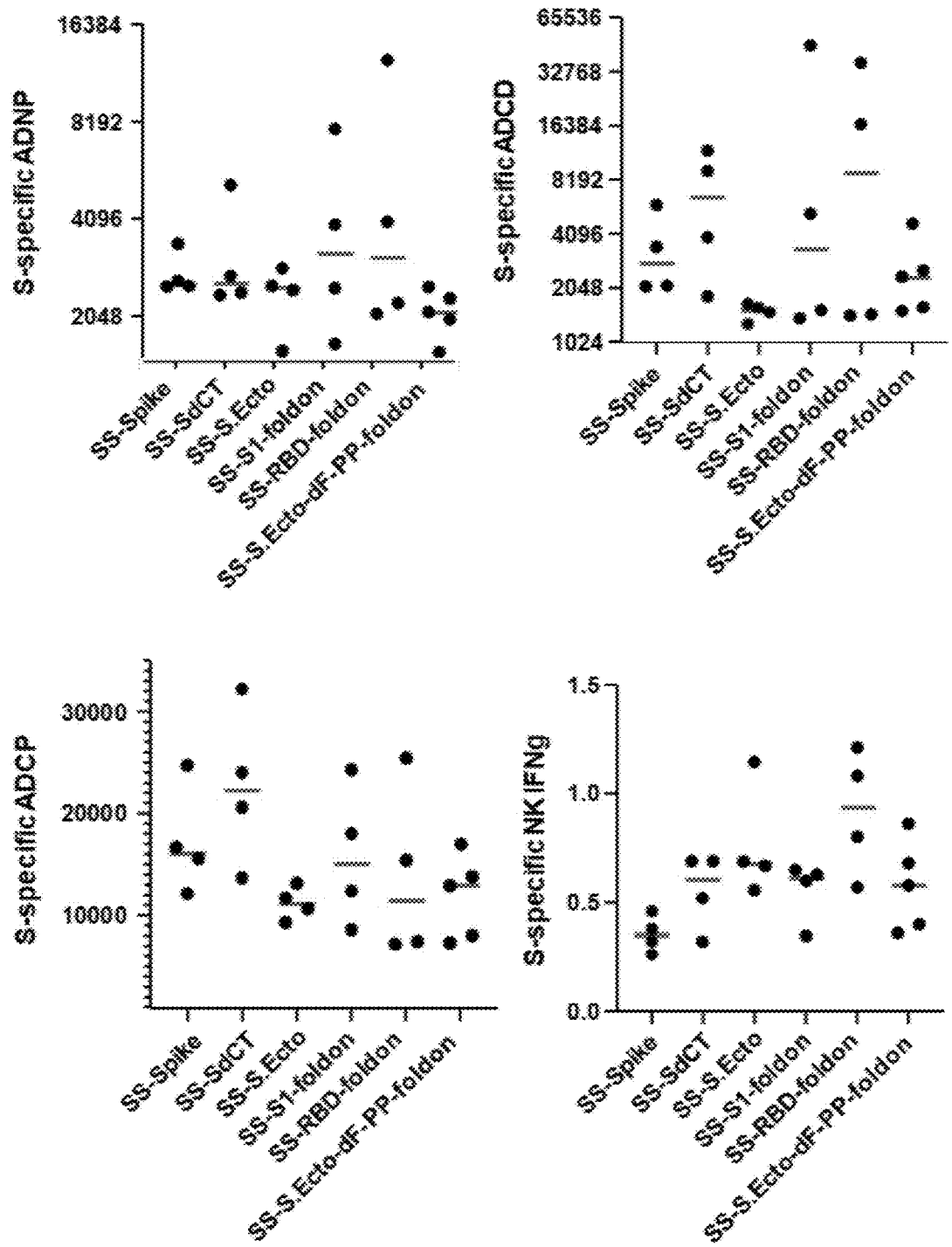
Figure 7A:
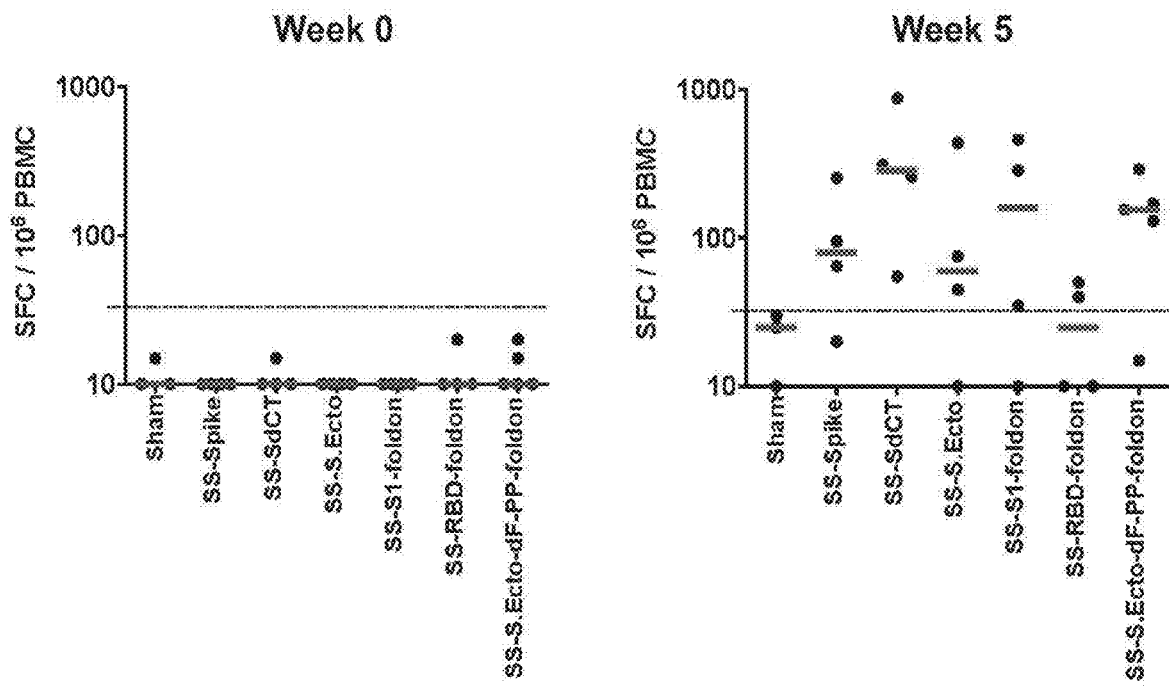
FIGS. 7A-7B are graphs showing cellular immune responses in vaccinated rhesus macaques. Cellular immune responses were assessed following immunization by (FIG. 7A) IFN-γ ELISPOT assays and (FIG. 7B) multiparameter intracellular cytokine staining assays in response to pooled S peptides. Red bars reflect mean responses.
Figure 7B:
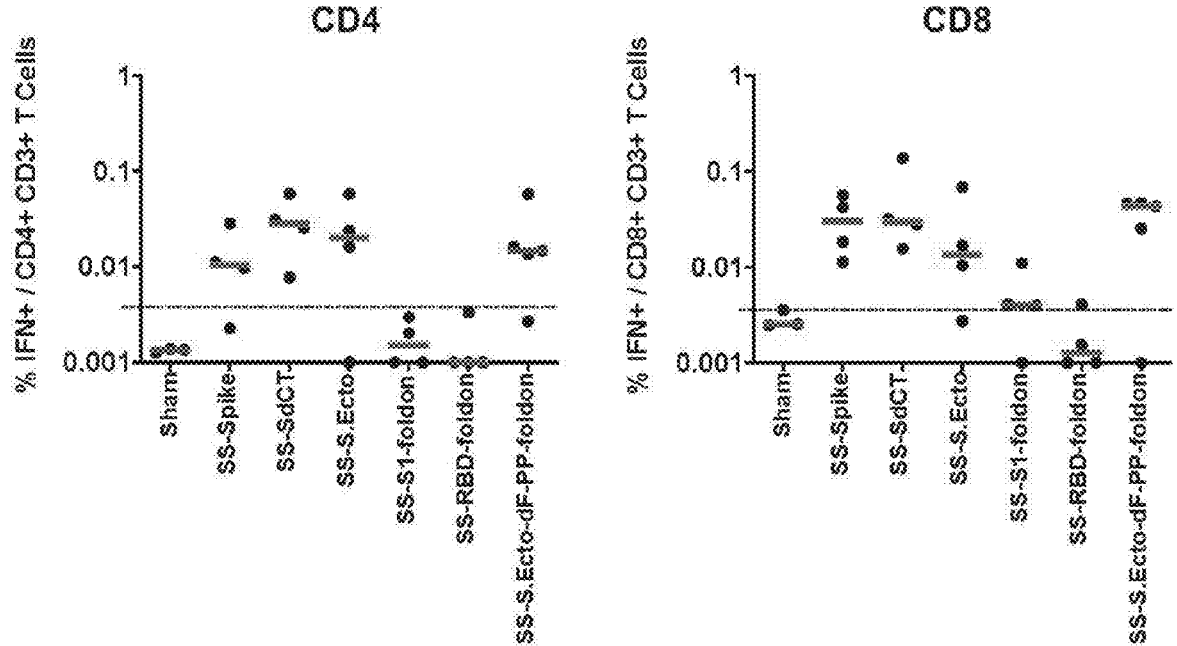
Figure 8A:
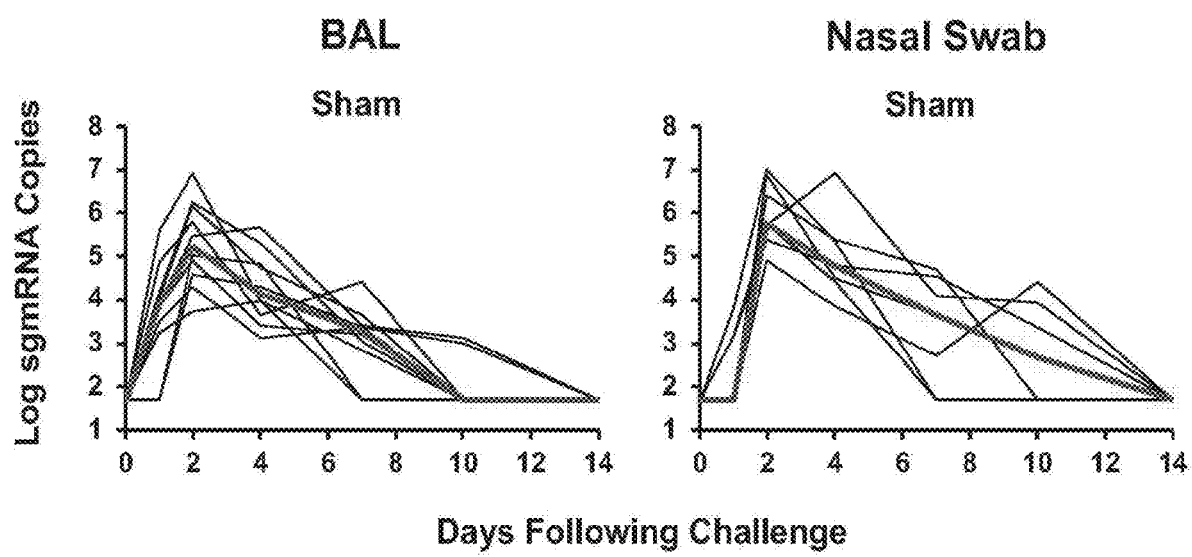
FIGS. 8A-8D are graphs showing viral loads in 2019-nCoV challenged rhesus macaques. Rhesus macaques were challenged by the intranasal and intratracheal route with $1.2 \times 10^{12}$ VP ($1.1 \times 10^4$ PFU) 2019-nCoV.
Figure 8B:
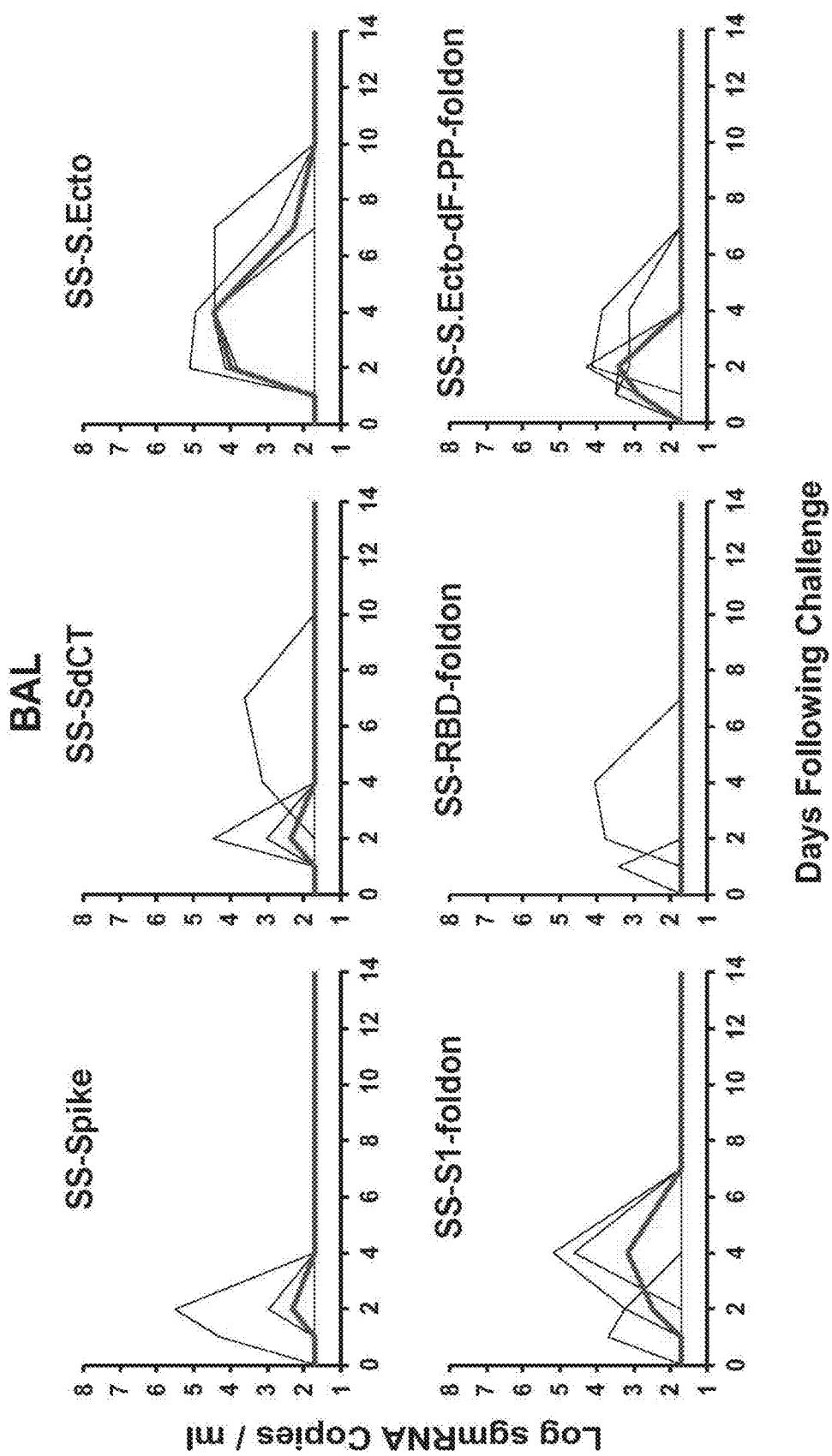
Figure 8C:
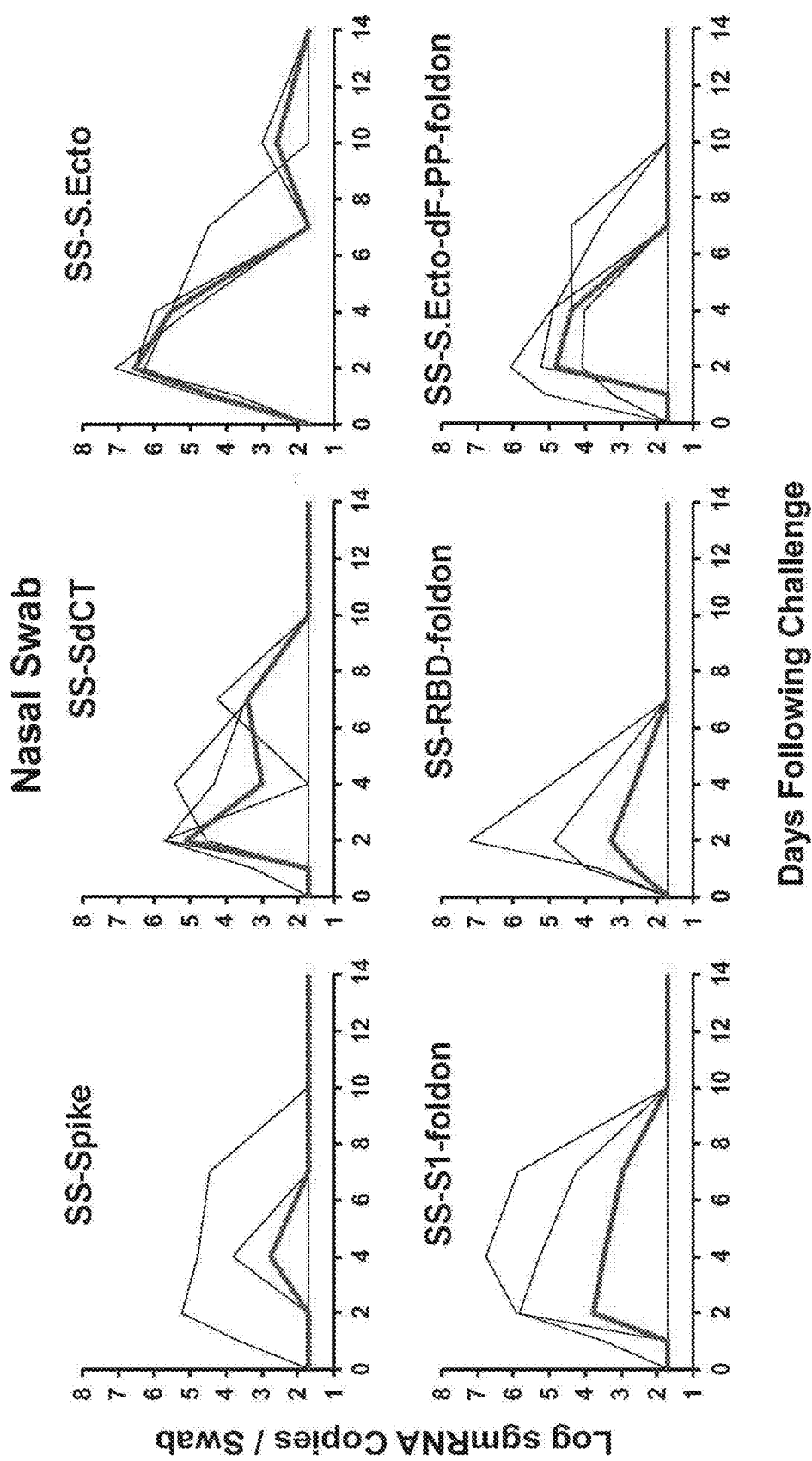
Figure 8D:
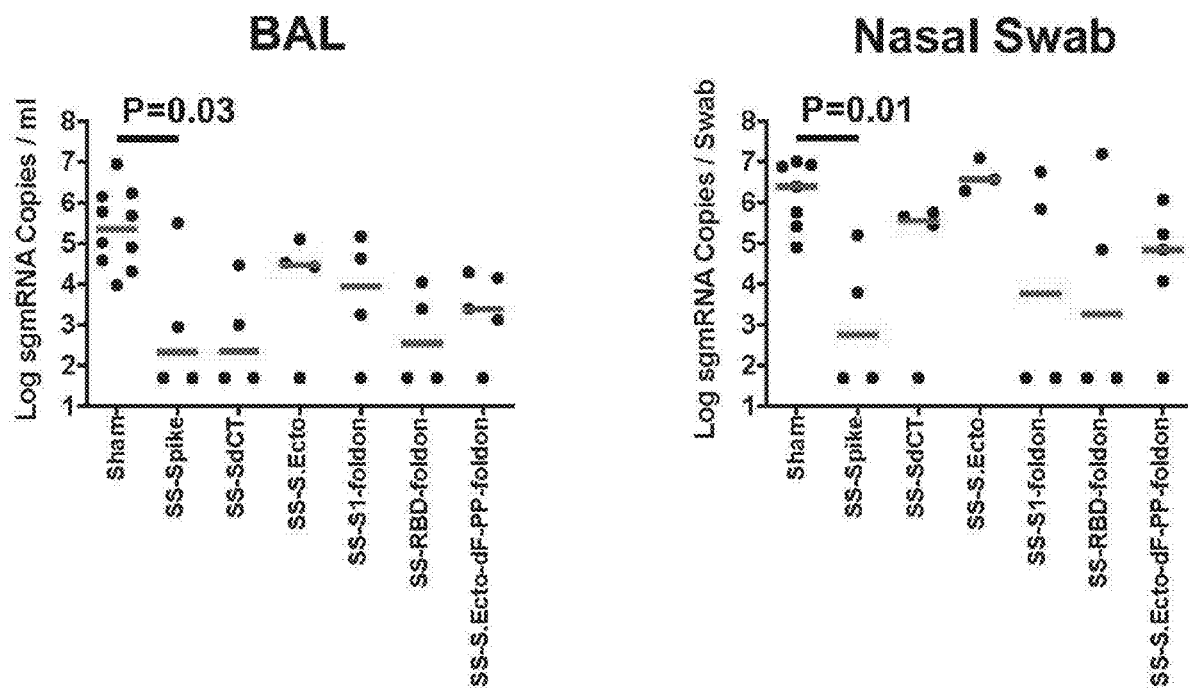

Serum from 4-week post-vaccination mice was further analyzed for neutralization activity. Neutralization activity was assessed using an in vitro luciferase-based pseudovirus neutralization assay. The neutralization assay used a retroviral core pseudotyped with the 2019-nCoV Spike protein (SEQ ID NO: 1). Infectivity was tested in 293 cells that were transduced with human angiotensin converting enzyme 2 (ACE2), the receptor for 2019-nCoV, in order to support pseudovirus entry. Substantial neutralization capacity was observed in mice treated with the DNA vaccines SS-S.Ecto, SS-RBD-foldon, and SS-S.Ecto-dF-PP-foldon. Mice treated with the SS-S.Ecto-dF-PP-foldon DNA vaccine exhibited the most robust neutralizing capacity (FIG. 5).

Example 8. 2019-nCoV DNA Vaccines are Able to Elicit a Protective Immune Response Against Coronavirus Infection The rapidly expanding COVID-19 pandemic has made the development of a safe, effective, and deployable vaccine a critical global priority (1-8). However, the understanding of immune correlates of protection to 2019-nCoV is currently very limited. Such knowledge is essential for the development of 2019-nCoV vaccines as well as other immunotherapeutic interventions. In this study, a set of prototype DNA vaccines were constructed that express various forms of the 2019-nCoV Spike (S) protein and assessed their immunogenicity and protective efficacy against 2019-nCoV challenge in rhesus macaques.

Methods

Animals and study design. 35 outbred Indian-origin adult male and female rhesus macaques (*Macaca mulatta*), 6-12 years old, were randomly allocated to groups. All animals were housed at Bioqual, Inc. (Rockville, Md.). Animals received DNA vaccines expressing SS-Spike (N=4), SS-SdCT (N=4), SS-S.Ecto (N=4), S1 (N=4), SS-RBD-FOLDON (N=4), SS-S.Ecto-dF-PP-foldon (N=5), and sham controls (N=10). Animals received 5 mg DNA vaccines at week 0 and week 3. At week 6, all animals were challenged with $1.2 \times 10^8$ VP ($1.1 \times 10^4$) PFU 2019-nCoV. Virus was administered as 1 ml by the intranasal (IN) route (0.5 ml in each nare) and 1 ml by the intratracheal (IT) route. All immunologic and virologic assays were performed blinded. All animal studies were conducted in compliance with all relevant local, state, and federal regulations and were approved by the Bioqual Institutional Animal Care and Use Committee (IACUC).

Human samples. 27 de-identified human serum samples from 2019-nCoV convalescent individuals from Boston, Mass. were obtained from individuals at least 7 days after documented recovery with negative nasal swab. All human studies were conducted in compliance with all relevant local, state, and federal regulations and were approved by the Partners Institutional Review Board (IRB).

DNA Vaccines. DNA vaccines were designed based on the 2019-nCoV spike (S) protein sequence (Wuhan/WIV04/

2019). Sequences were codon optimized and commercially synthesized (Integrated DNA Technologies, NJ, USA). Six versions of Spike were produced (full length SS-Spike; deletion of cytoplasmic domain SS-SdCT; soluble ectodomain SS-S.Ecto; S1 domain with foldon trimerization tag SS-S1-foldon; receptor binding domain with foldon trimerization tag SS-RBD-foldon; soluble ectodomain with deletion of furin cleavage site, PP stabilizing mutations, and foldon trimerization tag SS-S.Ecto-dF-PP-foldon). Synthetic genes were cloned into the mammalian expression plasmid pcDNA3.1+(Invitrogen, CA, USA) and expanded with endotoxin-free gigaprep kits (Machery-Nagel, Duren, Germany). All DNA vaccine sequences were confirmed by Sanger DNA sequencing.

Western Blot. T-25 flasks seeded with 293T cells at 70-80% confluency were transiently transfected with 2019-nCoV DNA expression plasmids (10 μg DNA/construct) using Lipofectamine 2000 (Invitrogen) and supernatants and cell lysates harvested 48 hours post-transfection separately mixed with reducing sample buffer (Pierce), heated for 5 minutes at 95° C. and run on a precast 4-15% SDS-PAGE gel (Bio-Rad). Protein was transferred to a polyvinylidene difluoride (PVDF) membrane using an iBlot dry blotting system (Invitrogen), and membrane blocking performed overnight at 4° C. in Dulbecco's phosphate-buffered saline T (D-PBST) containing 0.2% Tween 20 (Sigma) (V/V) and 5% (W/V) non-fat milk powder. Following overnight blocking, the PVDF membrane was incubated for 1 hour in 3% milk DPBS-T containing a 1:10,000 dilution of (cross-reactive) polyclonal guinea pig anti-SARS coronavirus antiserum (BEI resources) for 1 hour. After this incubation, the PVDF membrane was washed five times with 5% milk DPBS-T and subsequently incubated with 1:30,000 anti-guinea pig horseradish peroxidase (HRP)-conjugated secondary antibody (Jackson Immunoresearch) in 3% milk DPBS-T. Finally, the PVDF membrane was washed again five times with 5% milk DPBS-T, and developed using an Amersham ECL Plus Western blotting detection system (GE Healthcare).

Viral RNA assay. RT-PCR assays were utilized to monitor viral loads, essentially as previously described (16). Briefly, RNA was extracted using a QIAcube HT (Qiagen, Germany) and the Cador pathogen HT kit from bronchoalveolar lavage (BAL) supernatant and nasal swabs. RNA was reverse transcribed using superscript VILO (Invitrogen) and ran in duplicate using the QuantStudio 6 and 7 Flex Real-Time PCR System (Applied Biosystems) according to manufacturer's specifications. Viral loads were calculated of viral RNA copies per mL or per swab and the assay sensitivity was 50 copies. The target for amplification was the 2019-nCoV N (nucleocapsid) gene. The primers and probes for the targets were:

```
2019-nCoV_N1-F:
                                      (SEQ ID NO: 196)
5'-GACCCCAAAATCAGCGAAAT-3'

2019-nCoV_N1-R:
                                      (SEQ ID NO: 197)
5'-TCTGGTTACTGCCAGTTGAATCTG-3'

2019-nCoV_N1-P:
                                      (SEQ ID NO: 198)
5'-FAM-ACCCCGCATTACGTTTGGTGGACC-BHQ1-3'
```

Subgenomic mRNA assay. 2019-nCoV E gene subgenomic mRNA (sgmRNA) was assessed by RT-PCR using an approach similar to previously described (17). To generate a standard curve, the 2019-nCoV E gene sgmRNA was cloned into a pcDNA3.1 expression plasmid; this insert was transcribed using an AmpliCap-Max T7 High Yield Message Maker Kit (Cellscript) to obtain RNA for standards. Prior to RT-PCR, samples collected from challenged animals or standards were reverse-transcribed using Superscript III VILO (Invitrogen) according to the manufacturer's instructions. A Taqman custom gene expression assay (ThermoFisher Scientific) was designed using the sequences targeting the E gene sgmRNA (17). Reactions were carried out on a QuantStudio 6 and 7 Flex Real-Time PCR System (Applied Biosystems) according to the manufacturer's specifications. Standard curves were used to calculate sgmRNA in copies per ml or per swab; the quantitative assay sensitivity was 50 copies per ml or per swab.

PFU assay. For plaque assays, confluent monolayers of Vero E6 cells were prepared in 6-well plates. Indicated samples collected from challenged animals were serially diluted, added to wells, and incubated at 37° C. for 1 hr. After incubation, 1.5 mL of 0.5% methylcellulose media was added to each well and the plates were incubated at 37° C. with 5% CO2 for 2 days. Plates were fixed by adding 400 μL ice cold methanol per well and incubating at −20° C. for 30 minutes. After fixation, the methanol was discarded, and cell monolayers were stained with 600 μL per well of 0.23% crystal violet for 30 minutes. After staining, the crystal violet was discarded, and the plates were washed once with 600 μL water to visualize and count plaques.

ELISA. Briefly, 96-well plates were coated with 1 μg/mL 2019-nCoV Spike (S) protein (Sino Biological) in 1×DPBS and incubated at 4° C. overnight. After incubation, plates were washed once with wash buffer (0.05% Tween20 in 1×DPBS) and blocked with 350 μL Casein block/well for 2-3 hours at room temperature. After incubation, block solution was discarded and plates were blotted dry. Serial dilutions of heat-inactivated serum diluted in Casein block were added to wells and plates were incubated for 1 hr at room temperature, prior to three further washes and subsequent 1 hr incubation with a 1:1000 dilution of anti-macaque IgG HRP (NIH NHP Reagent Program) in the dark at room temperature. Plates were then washed three times with wash buffer, and 100 μL of SERACARE® KPL TMB SureBlue Start solution was added to each well; plate development was halted by the addition of 100 μL SERACARE® KPL TMB Stop solution per well. The absorbance at 450 nm was recorded using a VERSAMAX™ or OMEGA® microplate reader. ELISA endpoint titers were defined as the highest reciprocal serum dilution that yielded an absorbance >0.2. Log 10 endpoint titers are reported.

Pseudovirus neutralization assay. The 2019-nCoV pseudoviruses expressing a luciferase reporter gene were generated in an approach similar to as described previously (9). Briefly, the packaging construct psPAX2 (AIDS Resource and Reagent Program), luciferase reporter plasmid pLenti-CMV Puro-Luc (Addgene), and Spike protein expressing pcDNA3.1-SARS CoV-2 SΔCT were co-transfected into HEK293T cells with calcium phosphate. The supernatants containing the pseudotype viruses were collected 48 hours post-transfection; pseudotype viruses were purified by filtration with 0.45 μm filter. To determine the neutralization activity of the antisera from vaccinated animals, HEK293T-hACE2 cells were seeded in 96-well tissue culture plates at a density of $1.75 \times 10^4$ cells/well overnight. Two-fold serial dilutions of heat inactivated serum samples were prepared and mixed with 50 μL of pseudovirus. The mixture was incubated at 37° C. for 1 hour before adding to HEK293T-hACE2 cells. Forty-eight hours after infection, cells were lysed in STEADY-GLO® Luciferase Assay (Promega) according to the manufacturer's instructions. 2019-nCoV neutralization titers were defined as the sample dilution at which a 50% reduction in RLU was observed relative to the average of the virus control wells. Live virus neutralization assay. A full-length 2019-nCoV virus based on the Seattle Wash. isolate was designed to express luciferase and GFP and was recovered via reverse genetics and described previously (13, 14). The virus was titered in Vero E6 USAMRID cells to obtain a relative light units (RLU) signal of at least 10× the cell only control background. Vero E6 USAMRID cells were plated at 20,000 cells per well the day prior in clear bottom black walled 96-well plates. Neutralizing antibody serum samples were tested at a starting dilution of 1:40 and were serially diluted 4-fold up to eight dilution spots. Antibody-virus complexes were incubated at 37° C. with 5% CO2 for 1 hour. Following incubation, growth media was removed and virus-antibody dilution complexes were added to the cells in duplicate. Virus-only controls and cell-only controls were included in each neutralization assay plate. Following infection, plates were incubated at 37° C. with 5% CO2 for 48 hours. After the 48 h incubation, cells were lysed and luciferase activity was measured via Nano-Glo Luciferase Assay System (Promega) according to the manufacturer specifications. 2019-nCoV neutralization titers were defined as the sample dilution at which a 50% reduction in RLU was observed relative to the average of the virus control wells.

Systems serology. For the functional analysis of serum samples, bead-based assays were used to quantify antibody-dependent cellular phagocytosis (ADCP), antibody-dependent neutrophil phagocytosis (ADNP) and antibody-dependent complement deposition (ADCD), as previously described (15). Protein antigens included receptor binding domain (RBD; courtesy Aaron Schmidt, Ragon Institute and MassCPR), prefusion stabilized Spike ectodomain (S; courtesy Bing Chen, Children's Hospital and MassCPR), and nucleocapsid (N; Sino Biological). Fluorescent streptavidin beads (Thermo Fisher) were coupled to biotinylated RBD, N and S and incubated with diluted serum (ADCP and ADNP 1:100, ADCD 1:10). For ADCP, THPs were added to the immune complexes and incubated for 16h at 37° C. For ADNP, primary neutrophils were isolated using ammonium-chlor-ide potassium (ACK) lysis buffer from whole blood. After 1h incubation at 37° C., neutrophils were stained with an anti-CD66b PacBlue detection antibody (Biolegend). For the ADCD assay, lyophilized guinea pig complement (Cedarlane) was resuspended according to manufacturer's instructions and diluted in gelatin veronal buffer with calcium and magnesium (Boston BioProducts). Post incubation, C3 was detected with Fluorescein-Conjugated Goat IgG Fraction to Guinea Pig Complement C3 (Mpbio). For detection of antibody-dependent NK cell activity, an ELISA-based approach was used. Briefly, plates were coated with 3 ug/mL of antigen (as mentioned above) and samples were added at a 1:50 dilution and incubated for 2h at 37° C. NK cells were isolated the day prior via RosetteSep (Stem Cell Technologies) from healthy buffy coats and rested overnight in 1 ng/mL IL-15 (Stemcell). NK cells were incubated with immune complexes for 5h at 37° C. with a staining cocktail containing CD107a PE-Cy5 (BD), Golgi stop (BD) and Brefeldin A (BFA, Sigma Aldrich). Post NK cell incubation, cells were fixed (Perm A, Life Tech) and stained for surface markers with anti-CD16 APC-Cy7 (BD), anti-CD56 PE-Cy7 (BD) and anti-CD3 PacBlue (BD) while fixing. Post permeabilization with Perm B (Life Tech), anti-IFN-gamma FITC (BD) and anti-MIP-1β PE (BD) antibodies were used for intracellular staining. All assays were acquired via flow cytometry with an iQue (Intellicyt) and an S-Lab robot (PAA). For ADCP, events were gated on bead-positive cells, whereas neutrophils were defined as CD66b positive followed by gating on bead-positive neutrophils. A phagocytosis score was calculated for ADCP and ADNP as (percentage of bead-positive cells) x (MFI of bead-positive cells) divided by 10000. ADCD was reported as MFI of C3 deposition. NK cells were defined as CD3-, CD16+ and CD56+. Data were reported as percentage of cells positive for CD107a, MIP-1-alpha or IFN-gamma. Both Pearson and Spearman correlations were used to explore linear and non-linear relationships between antibody features and login peak sgmRNA copies/mL in BAL, respectively. A Benjamini-Hochberg correction was used to correct for multiple comparisons. In addition, Pearson correlations were used to test all pairwise correlations of antibody features. To define the optimal features that correlate with protection, a partial least square regression (PLSR) and random forest regression (RFR) were performed using recursive feature elimination. First, all isotypes/subclasses and Fc-receptor binding data were $\log_{10}$ transformed. A PCA was constructed using the R package "ropls" to compare multivariate profiles. The PLSR was performed using the R package 'ropls' was used, and the random forest was performed using the R package 'random Forest'. Each model (i.e. each set of features) was fitted for 10 repetitions of 5-fold cross-validation. In each step of the feature elimination, for PLSR the feature which had the lowest mean (across folds) variable importance of projection (VIP) score and for RFR the feature with the lowest mean (across folds) importance measured as node impurity was removed. All possible combinations of two features were tested.

ELISPOT assay. ELISPOT plates were coated with mouse anti-human IFN-γ monoclonal antibody from BD Pharmingen at a concentration of 5 pg/well overnight at 4° C. Plates were washed with DPBS containing 0.25% Tween20, and blocked with R10 media (RPMI with 11% FBS and 1.1% penicillin-streptomycin) for 1 h at 37° C. Spike 1 and Spike 2 peptide pools were prepared at a concentration of 2 pg/well, and 200,000 cells/well were added. The peptides and cells were incubated for 18-24 h at 37° C. All steps following this incubation were performed at room temperature. The plates were washed with coulter buffer and incubated for 2 h with Rabbit polyclonal anti-human IFN-γ Biotin from U-Cytech (1 μg/mL). The plates are washed a second time and incubated for 2 h with Streptavidin-alkaline phosphatase antibody from Southern Biotechnology (1 μg/mL). The final wash was followed by the addition of Nitor-blue Tetrazolium Chloride/5-bromo-4-chloro 3'indolyl phosphate p-toludine salt (NBT/BCIP chromagen) substrate solution for 7 minutes. The chromagen was discarded and the plates were washed with water and dried in a dim place for 24 hours. Plates were scanned and counted on a Cellular Technologies Limited Immunospot Analyzer.

Intracellular cytokine staining assay. $10^8$ PBMCs/well were re-suspended in 100 μL of R10 media supplemented with CD49d monoclonal antibody (1 μg/mL). Each sample was assessed with mock (100 μL of R10 plus 0.5% DMSO; background control), Spike 1 and Spike 2 peptide pools (2 μg/mL), or 10 μg/mL phorbol myristate acetate (PMA) and 1 μg/mL ionomycin (Sigma-Aldrich) (100 μL; positive control) and incubated at 37° C. for 1 h. After incubation, 0.25 μL of GolgiStop and 0.25 μL of GolgiPlug in 50 μL of R10 was added to each well and incubated at 37° C. for 8 h and then held at 4° C. overnight. The next day, the cells were washed twice with DPBS, stained with Near IR live/dead dye for 10 mins and then stained with predetermined titers of mAbs against CD279 (clone EH12.1, BB700), CD38 (clone OKT10, PE), CD28 (clone 28.2, PE CY5), CD4 (clone L200, BV510), CD45 (clone D058-1283, BUV615), CD95 (clone DX2, BUV737), CD8 (clone SKI, BUV805), for 30 min. Cells were then washed twice with 2% FBS/DPBS buffer and incubated for 15 min with 200 μL of BD CytoFix/CytoPerm Fixation/Permeabilization solution. Cells were washed twice with 1× Perm Wash buffer (BD Perm/Wash™ Buffer 10× in the CytoFix/CytoPerm Fixation/Permeabilization kit diluted with MilliQ water and passed through 0.22 μm filter) and stained with intracellularly with mAbs against Ki67 (clone B56, FITC), CD69 (clone TP1.55.3, ECD), IL10 (clone JES3-9D7, PE CY7), IL13 (clone JES10-5A2, BV421), TNF-α (clone Mab11, BV650), IL4 (clone MP4-25D2, BV711), IFN-γ (clone B27; BUV395), IL2 (clone MQ1-17H12, APC), CD3 (clone SP34.2, Alexa 700), for 30 min. Cells were washed twice with 1× Perm Wash buffer and fixed with 250 μL of freshly prepared 1.5% formaldehyde. Fixed cells were transferred to 96-well round bottom plate and analyzed by BD FACSymphony™ system.

Statistical analyses. Analysis of virologic and immunologic data was performed using GraphPad Prism 8.4.2 (GraphPad Software). Comparison of data between groups was performed using two-sided Mann-Whitney tests. Correlations were assessed by two-sided Spearman rank-correlation tests. P-values of less than 0.05 were considered significant.

Results

Construction and Immunogenicity of DNA Vaccines

DNA vaccines expressing six variants of the 2019-nCoV S protein were produced: full-length (SS-Spike), deletion of the cytoplasmic tail (SS-SdCT) (9), deletion of the transmembrane domain and cytoplasmic tail reflecting the soluble ectodomain (SS-S.Ecto) (9), S1 domain with a foldon trimerization tag (SS-S1-foldon), receptor-binding domain with a foldon trimerization tag (SS-RBD-foldon), and a prefusion stabilized soluble ectodomain with deletion of the furin cleavage site, two proline mutations, and a foldon trimerization tag (SS-S.Ecto-dF-PP-foldon) (10-12) (FIG. 1). Western blot analyses confirmed expression in cell lysates for the S, SS-SdCT, SS-S.Ecto, and SS-S.Ecto-dF-PP-foldon constructs and in culture supernatants for the soluble SS-S.Ecto and SS-S.Ecto-dF-PP-foldon constructs (FIG. 6). Proteolytic cleavage of the secreted protein was noted for SS-S.Ecto but not SS-S.Ecto-dF-PP-foldon, presumably due to mutation of the furin cleavage site in SS-S.Ecto-dF-PP-foldon.

35 adult rhesus macaques, 6-12 years old, were immunized with DNA vaccines in the following groups: SS-Spike (N=4), SS-SdCT (N=4), SS-S.Ecto (N=4), S1 (N=4), SS-RBD-FOLDON (N=4), SS-S.Ecto-dF-PP-foldon (N=5), and sham controls (N=10). Animals received 5 mg DNA vaccines at week 0 and week 3. After the boost immunization at week 5, S-specific binding antibodies were observed by ELISA (FIG. 6A) and neutralizing antibodies (NAbs) using both a pseudovirus neutralization assay (9) (FIG. 6B) and a live virus neutralization assay (13, 14) (FIG. 6C). Two animals had binding antibodies at baseline by ELISA, which might reflect cross-reactivity of other natural primate coronaviruses. NAb titers measured by the pseudovirus neutralization assay correlated with NAb titers measured by the live virus neutralization assay (P<0.0001, R=0.8052, two-sided Spearman rank-correlation test; FIG. 10). Moreover, NAb titers in the vaccinated macaques (median titer 74; median titer in the S and SS-SdCT groups 170) were comparable in magnitude to NAb titers in a cohort of 9 convalescent macaques (median titer 106) and a cohort of 27 convalescent humans (median titer 93) who had recovered from 2019-nCoV infection (FIG. 6D).

S-specific and RBD-specific antibodies in the vaccinated macaques included diverse subclasses and effector functions, including antibody-dependent neutrophil phagocytosis (ADNP), antibody-dependent complement deposition (ADCD), antibody-dependent monocyte cellular phagocytosis (ADCP), and antibody-dependent NK cell activation (IFN-□ secretion, CD107a degranulation, and MIP-1β expression) (15) (FIG. 6E). A trend towards higher ADCD responses was observed in the S and SS-SdCT groups, whereas higher NK cell activation was observed in the SS-RBD-FOLDON and SS-S.Ecto-dF-PP-foldon groups. A principal component analysis of the functional and biophysical antibody features showed overlap of the different vaccine groups, with more distinct profiles in the S and RBD groups (FIG. 6E).

Cellular immune responses to pooled S peptides were also observed in the majority of vaccinated animals by IFN-γ ELISPOT assays at week 5 (FIG. 7A). Intracellular cytokine staining assays demonstrated induction of S-specific CD4+ and CD8+ T cell responses, with lower responses induced by the shorter SS-S1-foldon and SS-RBD-Foldon immunogens (FIG. 7B).

Protective Efficacy Against 2019-nCoV Challenge

At week 6, which was 3 weeks after the boost immunization, all animals were challenged with $1.2\times10^8$ VP ($1.1\times10^4$ PFU) 2019-nCoV, administered as 1 ml by the intranasal (IN) route and 1 ml by the intratracheal (IT) route. Following challenge, viral RNA levels were assessed by RT-PCR (16) in bronchoalveolar lavage (BAL) and nasal swabs (NS). Viral RNA was negative in plasma, and animals exhibited only mild clinical symptoms. High levels of viral RNA were observed in the sham controls with a median peak of 6.46 (range 4.81-7.99) $\log_{10}$ RNA copies/mL in BAL and a median peak of 6.82 (range 5.96-7.96) $\log_{10}$ RNA copies/swab in NS (FIG. 11). Lower levels of viral RNA were observed in the vaccine groups (FIG. 12, FIG. 13), including 1.92 and 2.16 $\log_{10}$ reductions of median peak viral RNA in BAL and NS, respectively, in SS-Spike vaccinated animals compared with sham controls (P=0.02 and P=0.04, two-sided Mann-Whitney tests) (FIG. 14). Viral RNA assays were confirmed by PFU assays.

A substantial fraction of viral RNA in BAL and NS following challenge were believed to represent input challenge virus, and thus levels of subgenomic mRNA (sgmRNA) were also assessed, which is believed to reflect viral replication cellular intermediates that are not packaged into virions and thus putative replicating virus in cells (17). High levels of sgmRNA were observed in the sham controls with a median peak of 5.35 (range 3.97-6.95) $\log_{10}$ sgmRNA copies/mL in BAL and a median peak of 6.40 (range 4.91-7.01) $\log_{10}$ sgmRNA copies/swab in NS (FIG. 8A). Markedly lower levels of sgmRNA were observed in the vaccine groups (FIG. 8B, 8C), including >3.1 and >3.7 $\log_{10}$ decreases of median peak sgmRNA in BAL and NS, respectively, in SS-Spike vaccinated animals compared with sham controls (P=0.03 and P=0.01, two-sided Mann-Whitney tests) (FIG. 8D). Reduced levels of sgmRNA were also observed in other vaccine groups, including SS-SdCT, SS-S1-foldon, SS-RBD-Foldon, and SS-S.Ecto-dF-PP-foldon, although lower protection was seen in the SS-S.Ecto group, confirming the importance of prefusion ectodomain stabilization, as reported previously (12). A total of 8 of 25 vaccinated animals exhibited no detectable sgmRNA in BAL and NS at any timepoint following challenge.

Immune Correlates of Protection

Figure 9A:
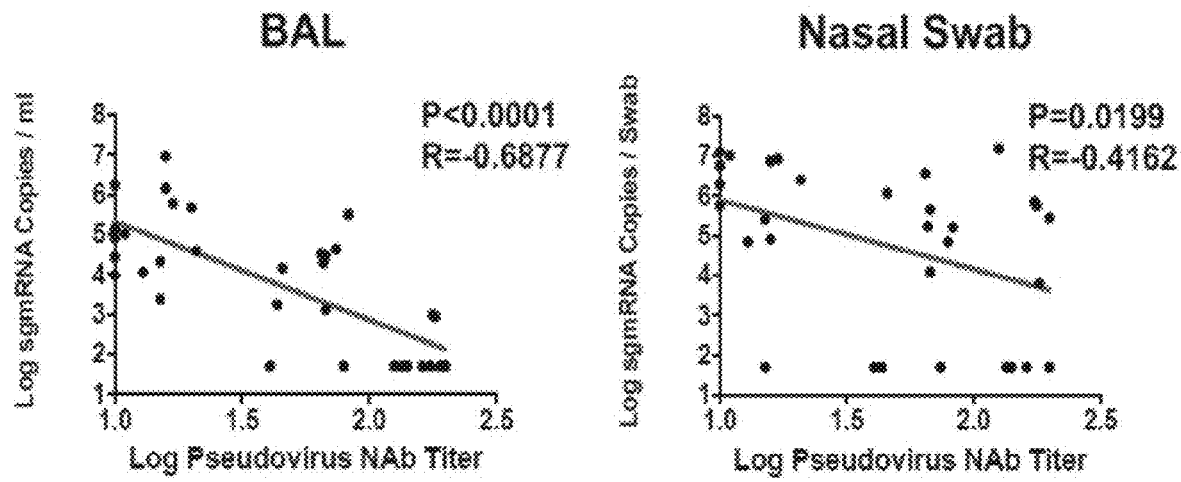
FIGS. 9A-9C are graphs showing immune correlates of protection. Correlations of (FIG. 9A) pseudovirus NAb titers and (FIG. 9B) live NAb titers prior to challenge with log peak sgmRNA copies/mL in BAL or log peak sgmRNA copies/swab in nasal swabs following challenge. Red lines reflect the best-fit relationship between these variables. P and R values reflect two-sided Spearman rank-correlation tests.
Figure 9B:
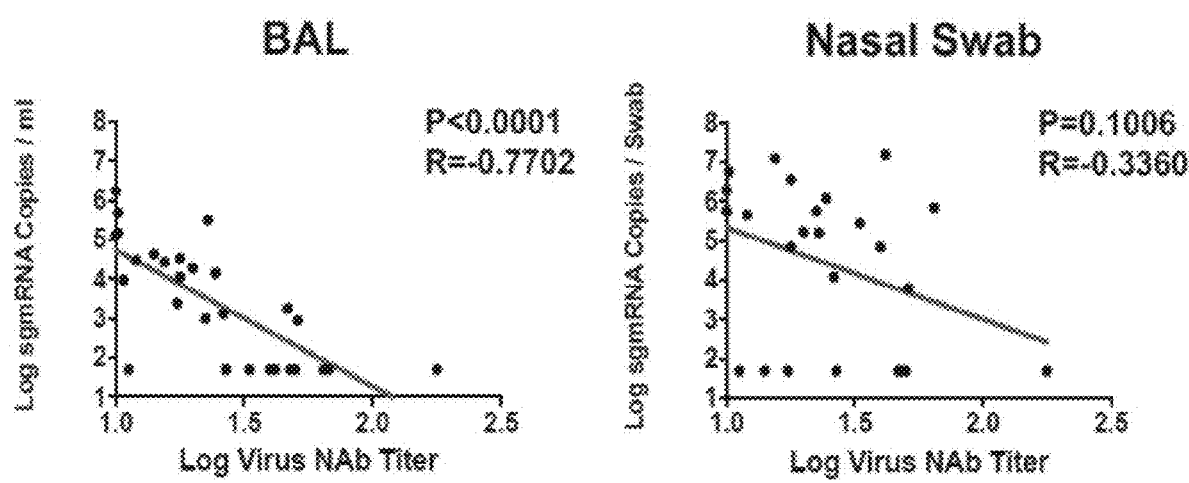
Figure 15:
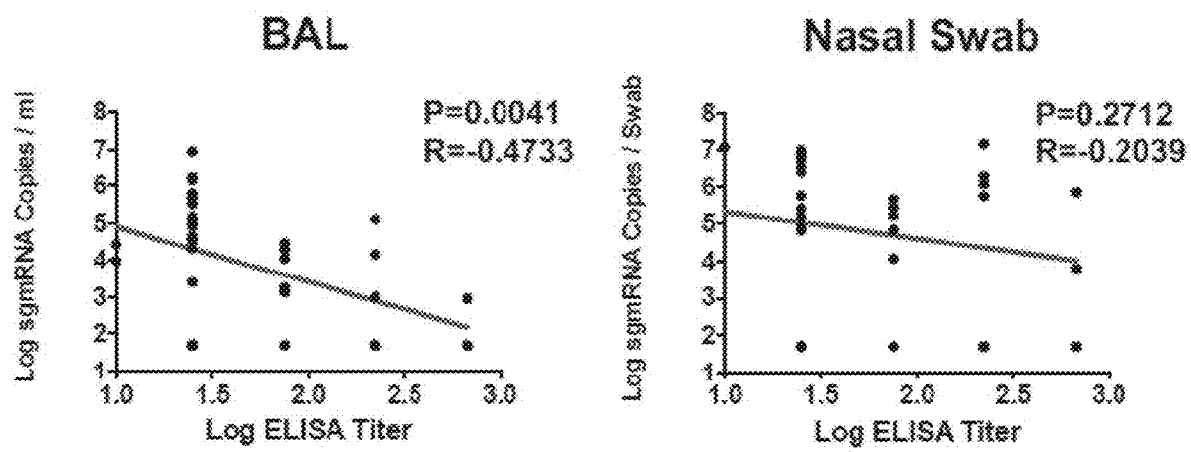
FIG. 15 is a graph showing correlations of log ELISA titers prior to challenge with log sgmRNA in BAL and nasal swabs following challenge. Red lines reflect the best-fit relationship between these variables. P and R values reflect two-sided Spearman rank-correlation tests.
Figure 16:
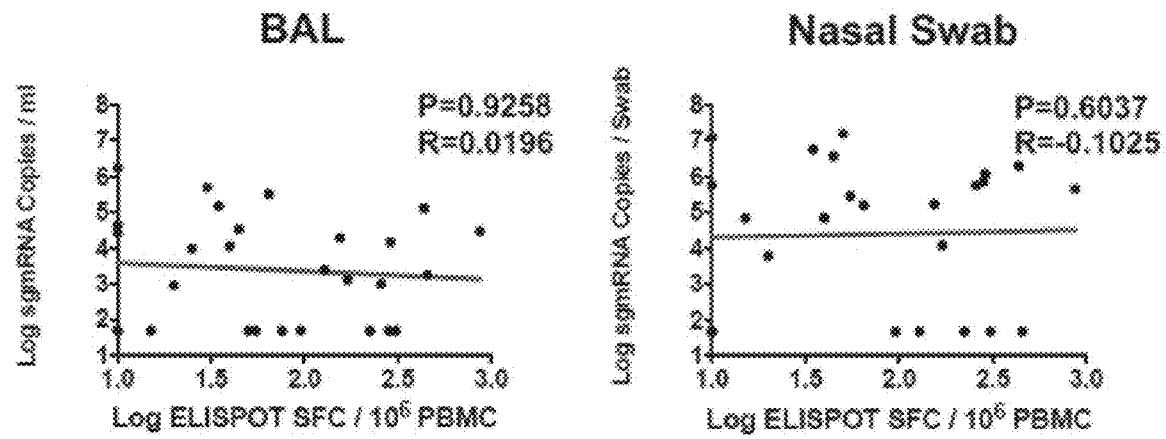
FIG. 16 is a graph showing correlations of log ELISPOT responses prior to challenge with log sgmRNA in BAL and nasal swabs following challenge. Red lines reflect the best-fit relationship between these variables. P and R values reflect two-sided Spearman rank-correlation tests.
Figure 17:
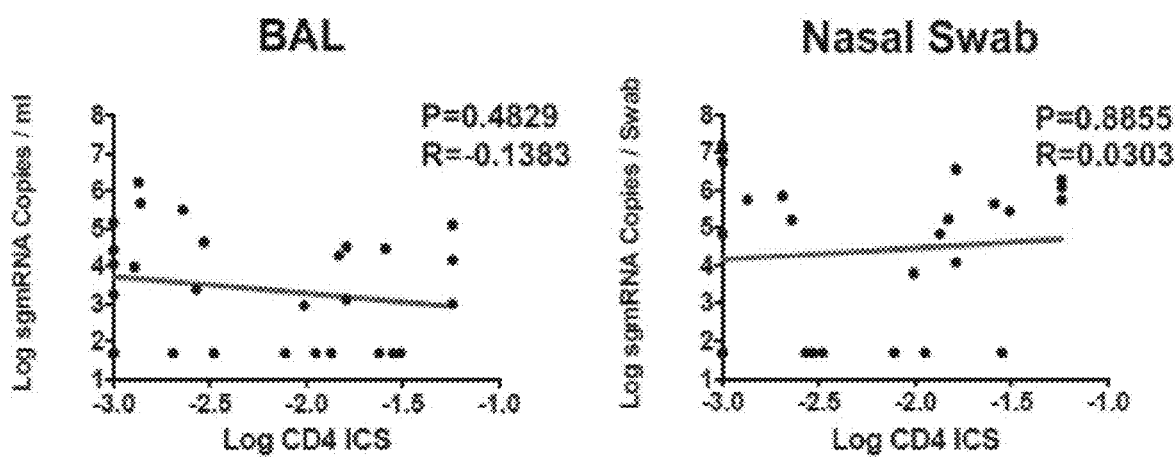
FIG. 17 is a graph showing correlations of log CD4+ ICS responses prior to challenge with log sgmRNA in BAL and nasal swabs following challenge. Red lines reflect the best-fit relationship between these variables. P and R values reflect two-sided Spearman rank-correlation tests.
Figure 18:
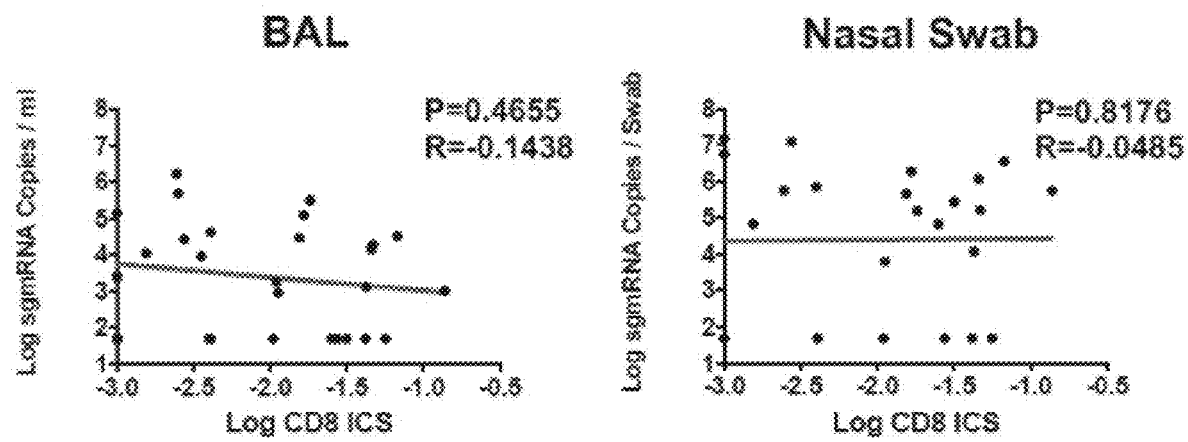
FIG. 18 is a graph showing correlations of log CD8+ ICS responses prior to challenge with log sgmRNA copies/mL in BAL and log sgmRNA copies/swab in nasal swabs following challenge. Red lines reflect the best-fit relationship between these variables. P and R values reflect two-sided Spearman rank-correlation tests.

The variability in protective efficacy in this study facilitated an analysis of immune correlates of protection. The $\log_{10}$ pseudovirus NAb titer at week 5 inversely correlated with peak $\log_{10}$ sgmRNA in both BAL (P<0.0001, R=−0.6877, two-sided Spearman rank-correlation test) and NS (P=0.0199, R=−0.4162) (FIG. 9A). Similarly, the $\log_{10}$ live virus NAb titer at week 5 inversely correlated with peak $\log_{10}$ sgmRNA levels in both BAL (P<0.0001, R=−0.7702) and NS (P=0.1006, R=−0.3360) (FIG. 9B). These data suggest that vaccine-elicited serum NAb titers may be robust immune correlates of protection against 2019-nCoV challenge. Correlations were speculated to be more robust with viral loads in BAL compared with viral loads in NS due to intrinsic variability of collecting swabs. The $\log_{10}$ ELISA titer at week 5 also inversely correlated with peak $\log_{10}$ sgmRNA levels in BAL (P=0.0041, R=−0.4733) (FIG. 15). Vaccine-elicited ELISPOT responses (FIG. 16), CD4+ ICS responses (FIG. 17), and CD8+ ICS responses (FIG. 18) did not correlate with protection.

Figure 9C:
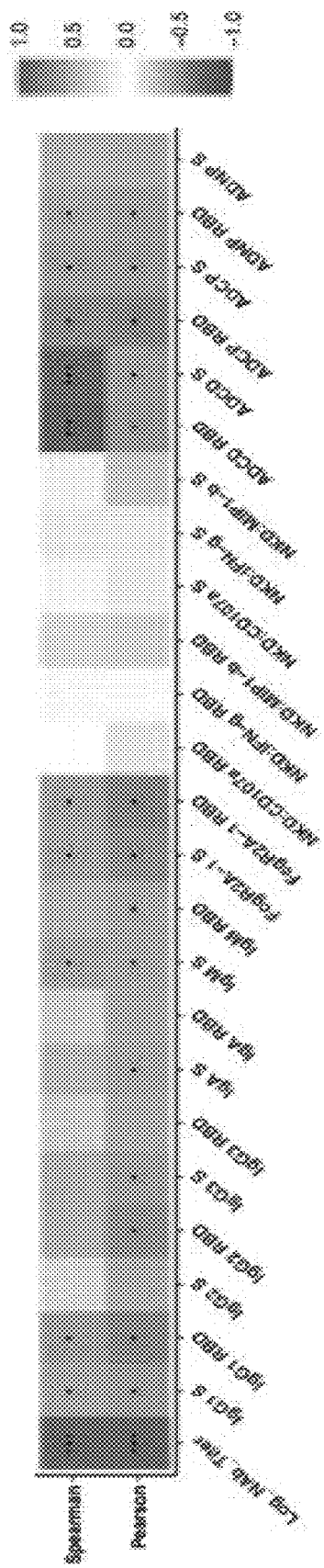
Figure 10:
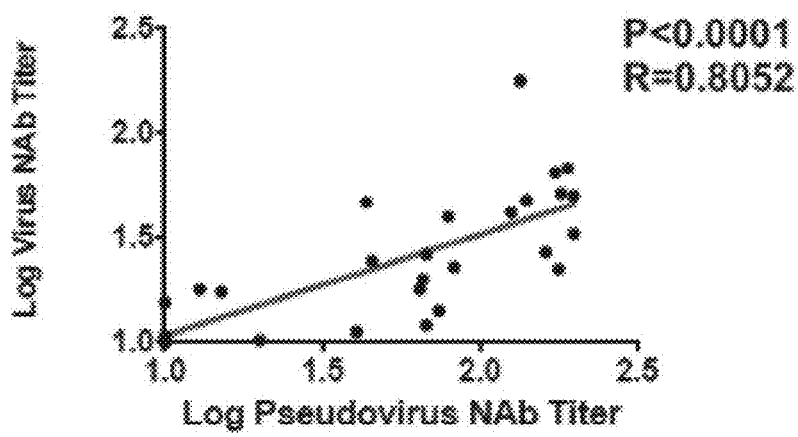
FIG. 10 is a graph showing correlation of pseudovirus and live virus NAb assays in vaccinated macaques. Red line reflects the best-fit relationship between these variables. P and R values reflect two-sided Spearman rank-correlation tests.
Figure 11:
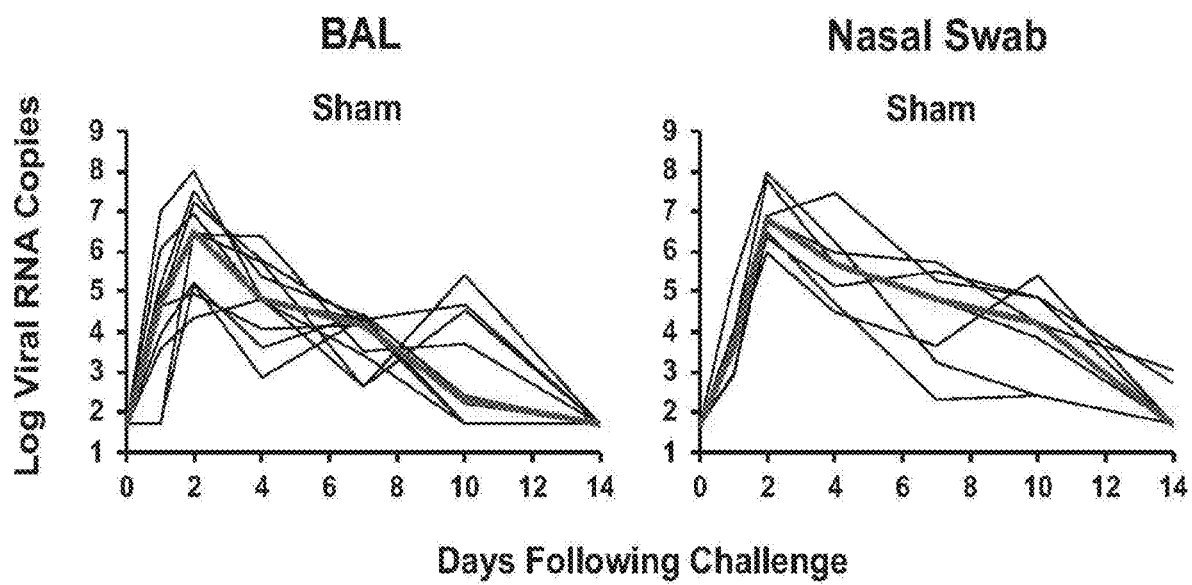
FIG. 11 is a graph showing viral RNA following 2019-nCoV challenge in sham controls in BAL and nasal swabs. Red lines reflect median viral loads.
Figure 12:
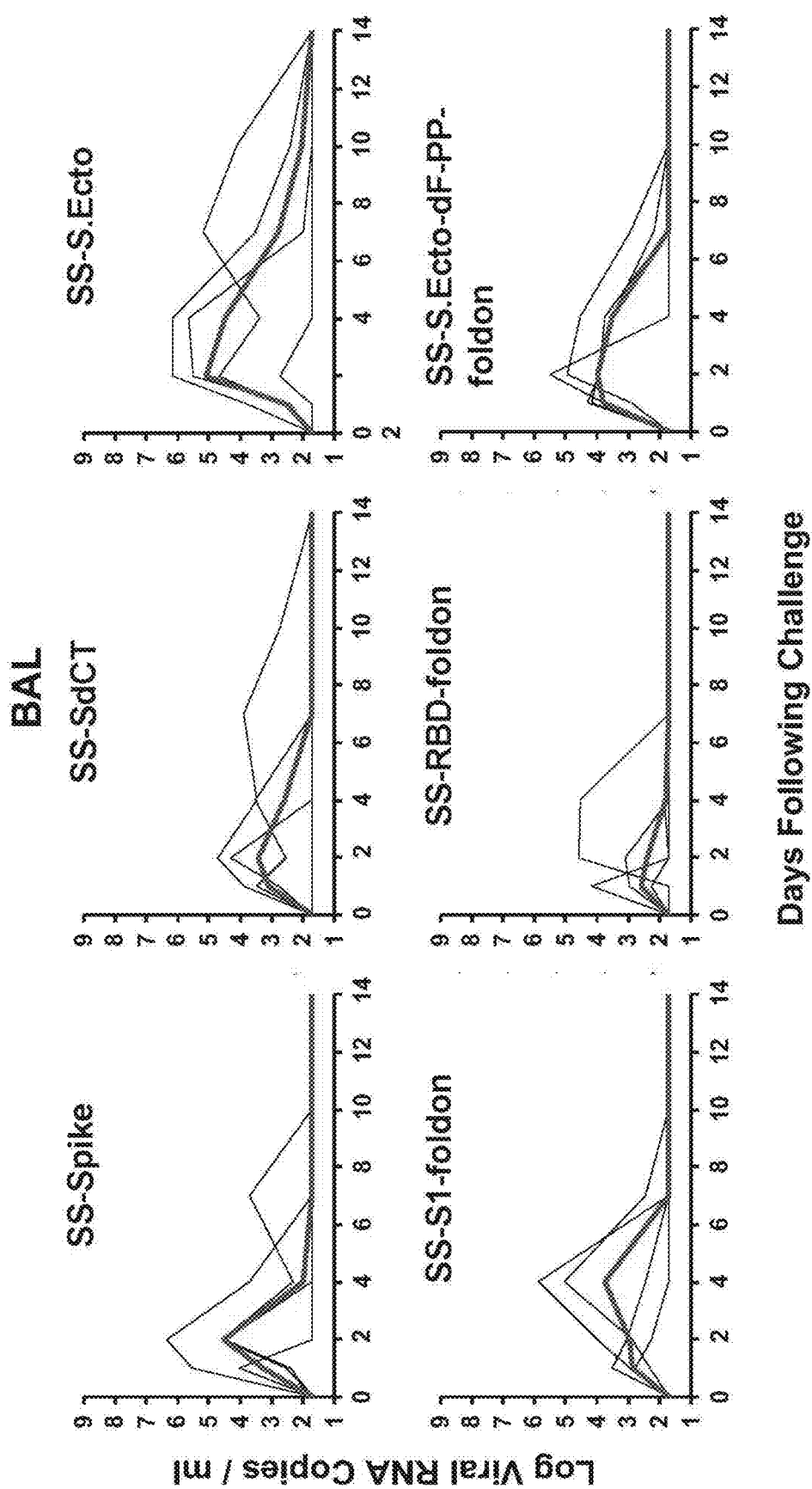
FIG. 12 is a graph showing viral RNA following 2019-nCoV challenge in vaccinated animals in BAL. Red lines reflect median viral loads.
Figure 13:
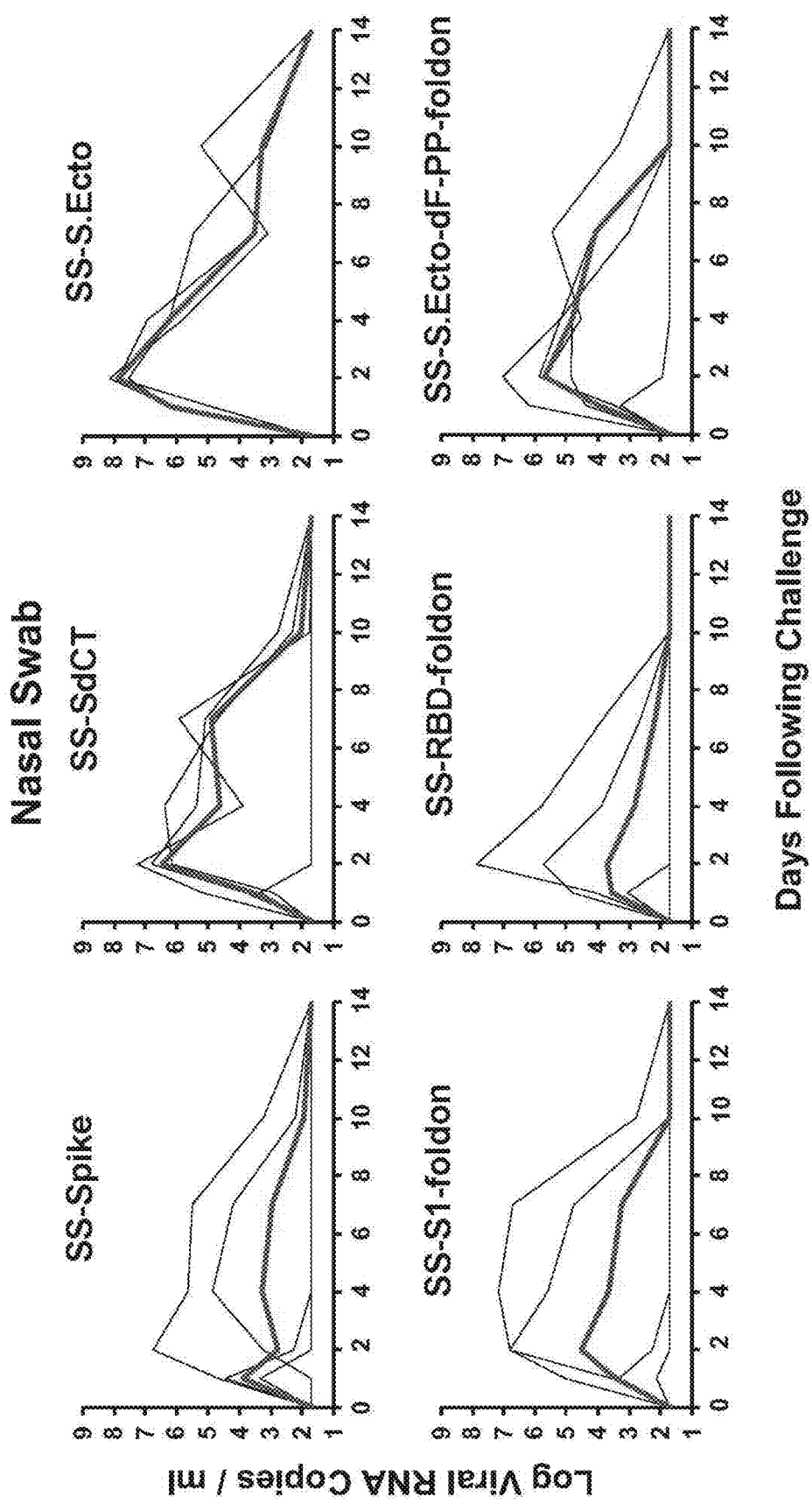
FIG. 13 is a graph showing viral RNA following 2019-nCoV challenge in vaccinated animals in nasal swabs. Red lines reflect median viral loads.
Figure 14:
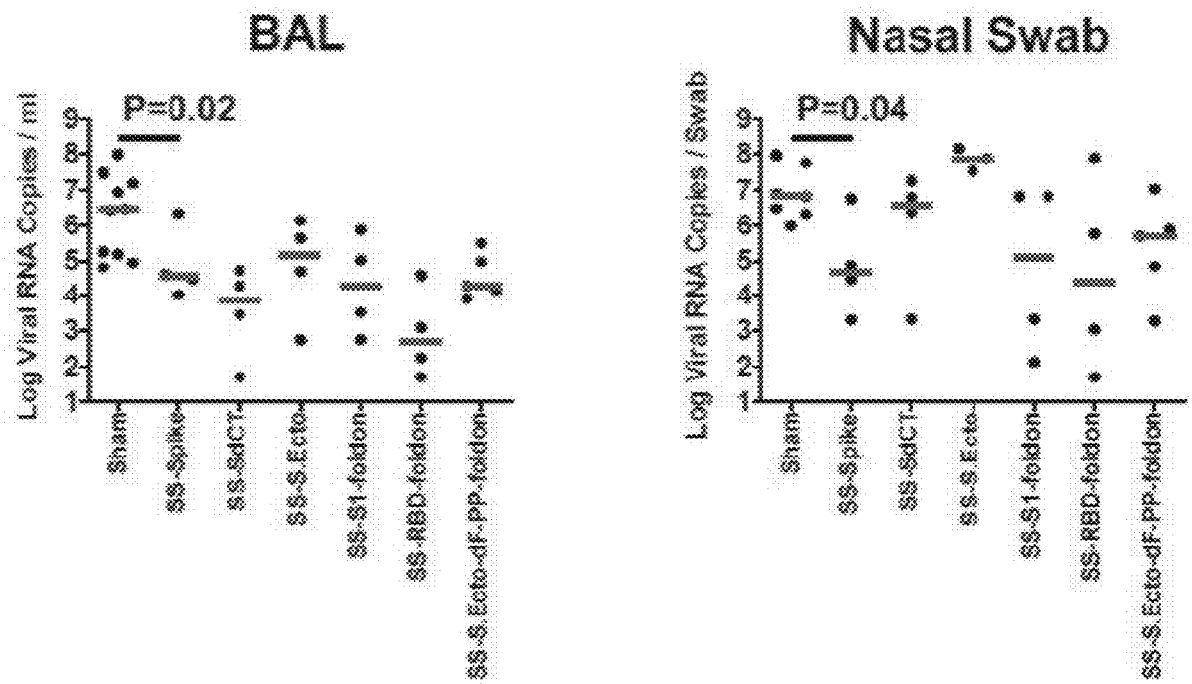
FIG. 14 is a graph showing Peak viral RNA following 2019-nCoV challenge in vaccinated animals in BAL and nasal swabs. Red lines reflect median viral loads. P-values indicate two-sided Wilcoxon rank-sum tests.

The potential contribution of other antibody effector functions to immune correlates of protection were explored next. In addition to NAb titers, S- and RBD-specific ADCD responses inversely correlated with peak $\log_{10}$ sgmRNA levels in BAL (FIG. 9C, top panel). Two orthogonal unbiased machine learning approaches were then utilized to define minimal combined correlates of protection. A nonlinear random forest analysis and a linear partial least squares regression analysis showed that utilizing two features improved the correlations with protection, such as RBD-specific Fc☐R2a-1 binding with ADCD responses, or NAb titers with RBD-specific IgG2 responses (FIG. 9C, bottom left panel). Moreover, NAb titers correlated with most antibody effector functions, except for antibody-mediated NK cell activation (FIG. 9C, bottom right panel). Taken together, these data suggest a primary role of NAbs in protecting against 2019-nCoV, supported by innate immune effector functions such as ADCD.

Anamnestic Immune Responses Following Challenge

Figure 19:
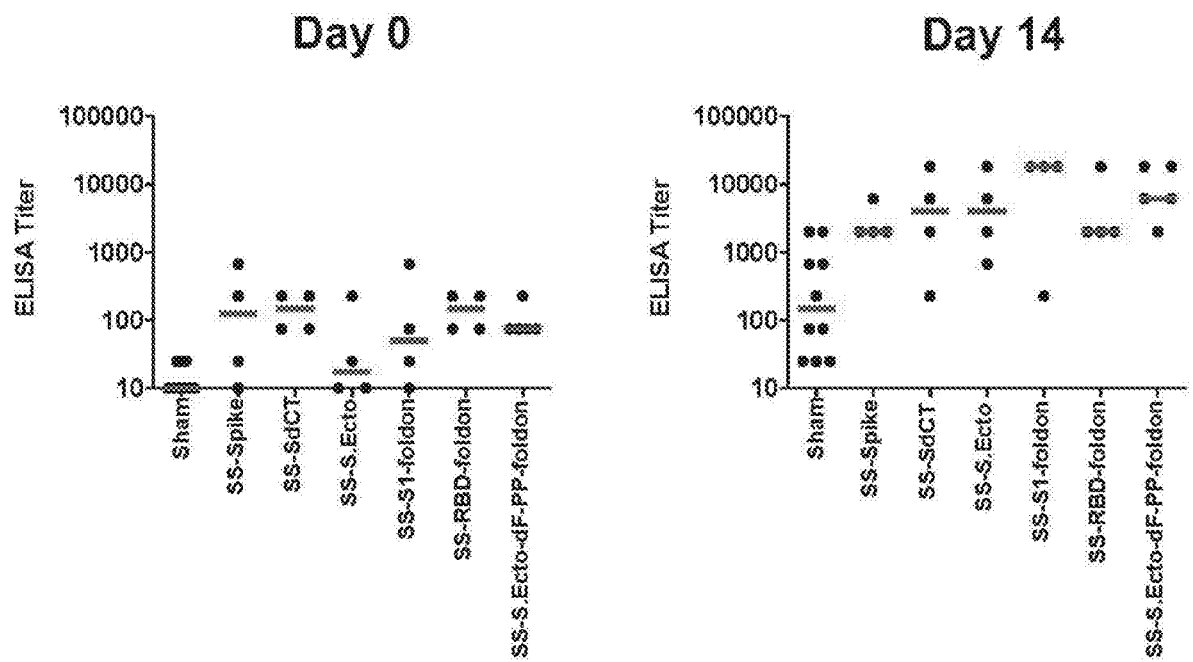
FIG. 19 is a graph showing anamnestic ELISA responses following challenge. Responses on day 0 and day 14 following challenge are shown. Red lines reflect median responses.
Figure 20:
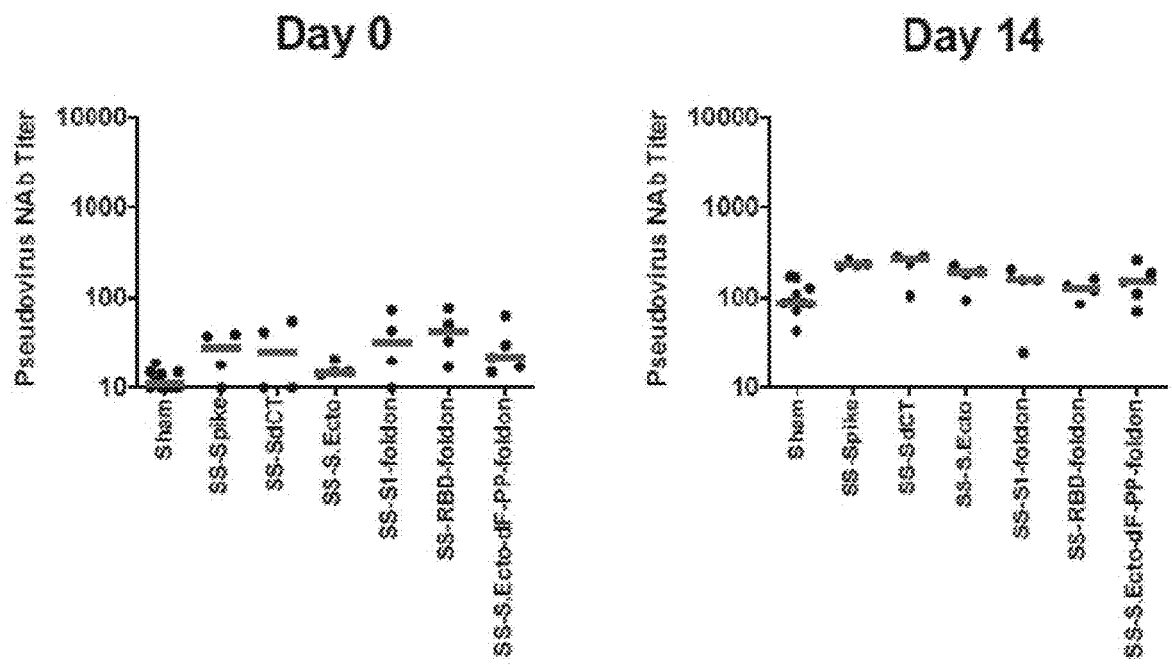
FIG. 20 is a graph showing anamnestic pseudovirus NAb responses following challenge. Responses on day 0 and day 14 following challenge are shown. Red lines reflect median responses.
Figure 21:
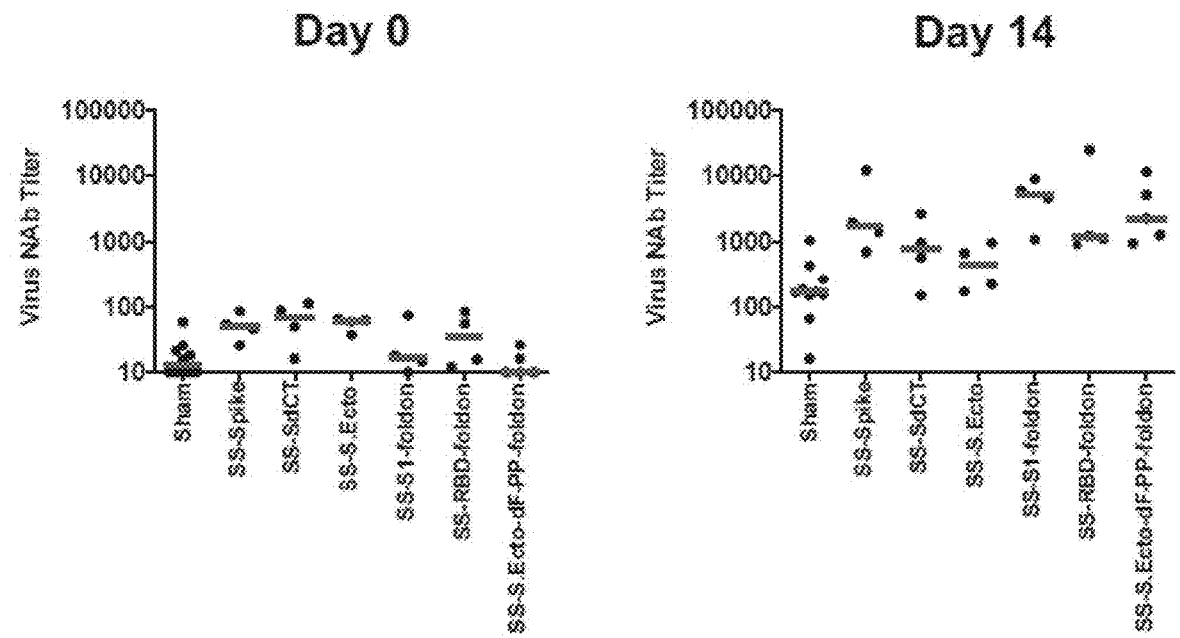
FIG. 21 is a graph showing anamnestic live virus NAb responses following challenge. Responses on day 0 and day 14 following challenge are shown. Red lines reflect median responses.
Figure 22:
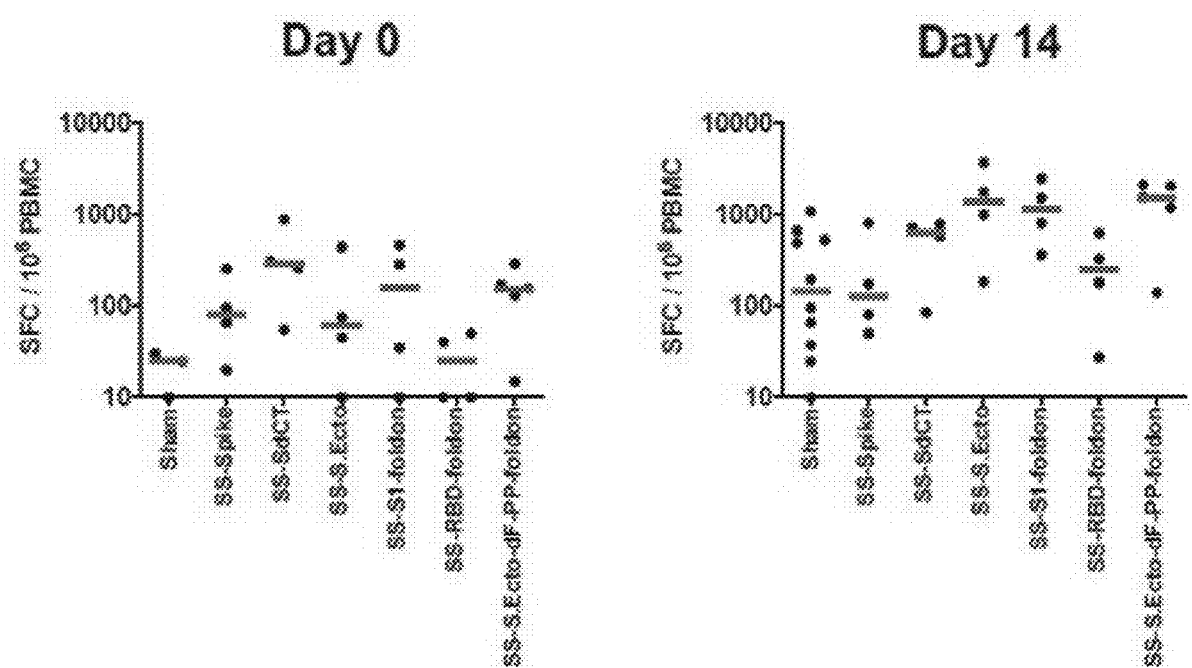
FIG. 22 is a graph showing anamnestic ELISPOT responses following challenge. Responses on day 0 and day 14 following challenge are shown. Red lines reflect median responses.

All animals exhibited anamnestic humoral and cellular immune responses following challenge, including increased ELISA titers (FIG. 19), pseudovirus NAb titers (FIG. 20), live virus NAb titers (FIG. 21), and IFN-γ ELISPOT responses (FIG. 22) on day 14 after challenge. These data suggest that vaccine protection was not sterilizing, including in the 8 of 25 animals that had no detectable sgmRNA in BAL and NS at any timepoint following challenge, but rather was likely mediated by rapid virologic control following challenge.

Discussion

A safe and effective 2019-nCoV vaccine may be required to end the global COVID-19 pandemic. Several vaccine candidates have initiated clinical testing, and many others are in preclinical development. However, very little is currently known about immune correlates of protection and protective efficacy of candidate 2019-nCoV vaccines in animal models. In this study, a series of prototype DNA vaccines expressing various S immunogens was generated and protective efficacy against intranasal and intratracheal 2019-nCoV challenge in rhesus macaques was assessed. We demonstrate robust vaccine protection with substantial >3.1 and >3.7 $\log_{10}$ reductions in median viral loads in BAL and NS, respectively, in S immunized animals compared with sham controls. Protection was not sterilizing but instead was likely mediated by rapid immunologic control following challenge.

Our data extend previous studies on SARS and MERS vaccine protection in mice, ferrets, and macaques (9, 18-21). Phase 1 clinical studies for SARS and MERS vaccine candidates have also been conducted (22), but these vaccines have not been tested for efficacy in humans. Our data suggest that protection against 2019-nCoV in macaques is feasible. A dramatic reduction of viral replication was observed in the upper and lower respiratory tract. Optimal protection was achieved with the full-length S immunogen, and reduced protection was observed with soluble constructs and smaller fragments. However, smaller immunogens may be useful in certain settings (e.g., different patient populations).

Further research will need to address the important questions of the durability of protective immunity and the optimal vaccine platforms for a 2019-nCoV vaccine for humans. Although the data is restricted to DNA vaccines, the findings can be generalizable to other gene-based vaccines as well, including RNA vaccines and recombinant vector-based vaccines. Further studies will also need to address the question of enhanced respiratory disease, which may result from antibody-dependent enhancement (23, 24). Enhanced clinical disease was not observed with the suboptimal vaccine constructs that failed to protect.

Serum NAb titers, as measured by two independent assays (pseudovirus neutralization and live virus neutralization), were identified as a robust correlate of protection in this study. If this correlate proves generalizable across multiple vaccine studies in both NHPs and humans, then this would be a useful benchmark for clinical development of 2019-nCoV vaccines. Innate immune effector functions such as ADCD may also contribute to protective efficacy.

In summary, vaccine protection against 2019-nCoV challenge in rhesus macaques has been demonstrated with a series of prototype DNA vaccines, and serum NAb titers have been identified as a correlate of protection in this model. This correlate should be further interrogated in multiple settings, but if confirmed, it may prove useful as a benchmark for testing 2019-nCoV vaccines in humans.

REFERENCES

1. F. Wu et al., A new coronavirus associated with human respiratory disease in China. *Nature* 579, 265-269 (2020).
2. P. Zhou et al., A pneumonia outbreak associated with a new coronavirus of probable bat origin. *Nature* 579, 270-273 (2020).
3. M. L. Holshue et al., First Case of 2019 Novel Coronavirus in the United States. *N Engl J Med* 382, 929-936 (2020).
4. Q. Li et al., Early Transmission Dynamics in Wuhan, China, of Novel Coronavirus-Infected Pneumonia. *N Engl J Med*, (2020).
5. N. Zhu et al., A Novel Coronavirus from Patients with Pneumonia in China, 2019. *N Engl J Med* 382, 727-733 (2020).
6. N. Chen et al., Epidemiological and clinical characteristics of 99 cases of 2019 novel coronavirus pneumonia in Wuhan, China: a descriptive study. *Lancet* 395, 507-513 (2020).
7. C. Huang et al., Clinical features of patients infected with 2019 novel coronavirus in Wuhan, China. *Lancet* 395, 497-506 (2020).

8. J. F. Chan et al., A familial cluster of pneumonia associated with the 2019 novel coronavirus indicating person-to-person transmission: a study of a family cluster. *Lancet* 395, 514-523 (2020).
9. Z. Y. Yang et al., A DNA vaccine induces SARS coronavirus neutralization and protective immunity in mice. *Nature* 428, 561-564 (2004).
10. R. N. Kirchdoerfer et al., Pre-fusion structure of a human coronavirus spike protein. *Nature* 531, 118-121 (2016).
11. J. Pallesen et al., Immunogenicity and structures of a rationally designed prefusion MERS-CoV spike antigen. *Proc Natl Acad Sci USA* 114, E7348-E7357 (2017).
12. D. Wrapp et al., Cryo-EM structure of the 2019-nCoV spike in the prefusion conformation. *Science* 367, 1260-1263 (2020).
13. T. Scobey et al., Reverse genetics with a full-length infectious cDNA of the Middle East respiratory syndrome coronavirus. *Proc Natl Acad Sci USA* 110, 16157-16162 (2013).
14. B. Yount et al., Reverse genetics with a full-length infectious cDNA of severe acute respiratory syndrome coronavirus. *Proc Natl Acad Sci USA* 100, 12995-13000 (2003).
15. A. W. Chung et al., Dissecting Polyclonal Vaccine-Induced Humoral Immunity against HIV Using Systems Serology. *Cell* 163, 988-998 (2015).
16. P. Abbink et al., Lack of therapeutic efficacy of an antibody to alpha4beta7 in SIVmac251-infected rhesus macaques. *Science* 365, 1029-1033 (2019).
17. R. Wolfel et al., Virological assessment of hospitalized patients with COVID-2019. *Nature*, (2020).
18. R. Liu et al., A recombinant VSV-vectored MERS-CoV vaccine induces neutralizing antibody and T cell responses in rhesus monkeys after single dose immunization. *Antiviral research* 150, 30-38 (2018).
19. K. Muthumani et al., A synthetic consensus anti-spike protein DNA vaccine induces protective immunity against Middle East respiratory syndrome coronavirus in nonhuman primates. *Sci Transl Med* 7, 301ra132 (2015).
20. G. P. Kobinger et al., Adenovirus-based vaccine prevents pneumonia in ferrets challenged with the SARS coronavirus and stimulates robust immune responses in macaques. *Vaccine* 25, 5220-5231 (2007).
21. J. Zhou et al., Immunogenicity, safety, and protective efficacy of an inactivated SARS-associated coronavirus vaccine in rhesus monkeys. *Vaccine* 23, 3202-3209 (2005).
22. J. E. Martin et al., A SARS DNA vaccine induces neutralizing antibody and cellular immune responses in healthy adults in a Phase I clinical trial. *Vaccine* 26, 6338-6343 (2008).
23. C. T. Tseng et al., Immunization with SARS coronavirus vaccines leads to pulmonary immunopathology on challenge with the SARS virus. *PLoS ONE* 7, e35421 (2012).
24. L. Liu et al., Anti-spike IgG causes severe acute lung injury by skewing macrophage responses during acute SARS-CoV infection. *JCI insight* 4, (2019).

Example 9. 2019-nCoV Natural Immune Response Against Coronavirus Infection

The explosive spread of the COVID-19 pandemic has made the development of countermeasures an urgent global priority (1-8). However, the understanding of the immunopathogenesis of 2019-nCoV is currently very limited. In particular, it is currently not known whether 2019-nCoV infection induces natural immunity that protects against re-exposure in humans. Such information is critical for vaccine strategies, epidemiologic modeling, and public health approaches. To explore this question, a rhesus macaque model of 2019-nCoV infection was developed, and virologic, immunologic, and pathologic features of infection were assessed, as well as protective immunity against re-challenge.

Methods

Animals and study design. 13 outbred Indian-origin adult male and female rhesus macaques (*Macaca mulatta*), 6-12 years old, were randomly allocated to groups. All animals were housed at Bioqual, Inc. (Rockville, Md.). In the first study, 9 animals were inoculated with 2019-nCoV at a total dose of: $1.1\times10^6$ plaque forming units (PFU) (Group 1; N=3), $1.1\times10^5$ PFU (Group 2; N=3), or $1.1\times10^4$ PFU (Group 3; N=3). These doses were administered as 1 ml by the intranasal (IN) route (0.5 ml in each nare) and 1 ml by the intratracheal (IT) route. On day 35 following challenge, animals were re-challenged with 2019-nCoV at matched doses to those utilized in the initial challenge. Semi-quantitative clinical scoring involved blinded assessments by veterinary staff on clinical appearance, dyspnea, recumbency, and responsiveness (10 points per category for a range of 0-40; mild disease <12; moderate disease 13-20; severe disease >20). In the second study, 4 rhesus macaques were inoculated with a total dose of $1.1\times10^5$ PFU 2019-nCoV, again administered by the IN and IT routes. Macaques were necropsied on either day 2 (N=2) or day 4 (N=2) post-challenge. All immunologic and virologic assays were performed blinded. All animal studies were conducted in compliance with all relevant local, state, and federal regulations and were approved by the Bioqual Institutional Animal Care and Use Committee (IACUC).

2019-nCoV stock. The 2019-nCoV USA-WA1/2020 stock was expanded from the BEI Resource (NR-52281; Lot #70033175; courtesy Natalie Thornburg, Centers for Disease Control and Prevention) in Vero E6 cells, and harvested the virus challenge stock on day 5 following infection at 90% cytopathic effect (CPE). Full genome sequencing revealed 100% identity with the parent virus sequence (GenBank MN985325.1; courtesy David O'Connor, Shelby O'Connor, University of Wisconsin).

Viral RNA assay. Viral RNA was quantified using an RT-PCR assay targeting the 2019-nCoV nucleocapsid. Briefly, RNA was isolated from samples collected from macaques (e.g., bronchoalveolar lavage (BAL) supernatant) either pre-challenge or at indicated timepoints post-challenge using a Qiagen MinElute virus spin kit or with RNA-STAT 60 (Tel-test B) and resuspended in RNAse-free water. Isolated RNA was plated in duplicate and amplified in an Applied Biosystems 7500 Sequence detector using the following program: i) 48° C. for 30 minutes, ii) 95° C. for 10 minutes, and iii) 40 cycles of 95° C. for 15 seconds and 1 minute at 55° C. The assay exhibited a practical range of $5\times10^1$-$5\times10^8$ RNA copies per ml for fluids or per gram for tissues. The forward (F) and reverse (R) primer sequences and the probe sequence (P) were:

2019-nCoV_N1-F:5'-GACCCCAAAATCAGCGAAAT-3' (SEQ ID NO: 196)

2019-nCoV_N1-R: 5'-TCTGGTTACTGCCAGTTGAATCTG-3' (SEQ ID NO: 197)

2019-nCoV_N1-P: 5'-FAM-ACCCCGCATTACGTTTGGTGGACC-BHQ1-3' (SEQ ID NO: 198)

Subgenomic mRNA assay. 2019-nCoV E gene subgenomic mRNA (sgmRNA) was assessed by RT-PCR using an approach similar to previously described (9). To generate a standard curve, the 2019-nCoV E gene sgmRNA was cloned into a pcDNA3.1 expression plasmid; this insert was transcribed using an AmpliCap-Max T7 High Yield Message Maker Kit (Cellscript) to obtain RNA for standards. Prior to RT-PCR, samples collected from challenged animals or standards were reverse-transcribed using Superscript III VILO (Invitrogen) according to the manufacturer's instructions. A Taqman custom gene expression assay (ThermoFisher Scientific) was designed using the sequences targeting the E gene sgmRNA (9). Reactions were carried out on a QuantStudio 6 and 7 Flex Real-Time PCR System (Applied Biosystems) according to the manufacturer's specifications. Standard curves were used to calculate sgmRNA in copies per ml or per swab; the quantitative assay sensitivity was 50 copies per ml or per swab.

PFU assay. For plaque assays, confluent monolayers of Vero E6 cells were prepared in 6-well plates. Indicated samples collected from challenged animals were serially diluted, added to wells, and incubated at 37° C. for 1 hr. After incubation, 1.5 mL of 0.5% methylcellulose media was added to each well and the plates were incubated at 37° C. with 5% $CO_2$ for 2 days. Plates were fixed by adding 400 μL ice cold methanol per well and incubating at −20° C. for 30 minutes. After fixation, the methanol was discarded, and cell monolayers were stained with 600 μL per well of 0.23% crystal violet for 30 minutes. After staining, the crystal violet was discarded, and the plates were washed once with 600 μL water to visualize and count plaques.

ELISA. Briefly, 96-well plates were coated with 1 μg/mL 2019-nCoV Spike (S) protein (Sino Biological) in 1×DPBS and incubated at 4° C. overnight. After incubation, plates were washed once with wash buffer (0.05% Tween20 in 1×DPBS) and blocked with 350 μL Casein block/well for 2-3 hours at room temperature. After incubation, block solution was discarded and plates were blotted dry. Serial dilutions of heat-inactivated serum diluted in Casein block were added to wells and plates were incubated for 1 hr at room temperature, prior to three further washes and subsequent 1 hr incubation with a 1:1000 dilution of anti-macaque IgG HRP (NIH NHP Reagent Program) in the dark at room temperature. Plates were then washed three times with wash buffer, and 100 μL of SERACARE® KPL TMB SureBlue Start solution was added to each well; plate development was halted by the addition of 100 μL SERACARE® KPL TMB Stop solution per well. The absorbance at 450 nm was recorded using a VERSAMAX™ or OMEGA® microplate reader. ELISA endpoint titers were defined as the highest reciprocal serum dilution that yielded an absorbance >0.2. Log 10 endpoint titers are reported.

Pseudovirus neutralization assay. The 2019-nCoV pseudoviruses expressing a luciferase reporter gene were generated in an approach similar to as described previously (10). Briefly, the packaging construct psPAX2 (AIDS Resource and Reagent Program), luciferase reporter plasmid pLenti-CMV Puro-Luc (Addgene), and Spike protein expressing pcDNA3.1-SARS CoV-2 SΔCT were co-transfected into HEK293T cells with calcium phosphate. The supernatants containing the pseudotype viruses were collected 48 hours post-transfection; pseudotype viruses were purified by filtration with 0.45 μm filter. To determine the neutralization activity of the antisera from vaccinated animals, HEK293T-hACE2 cells were seeded in 96-well tissue culture plates at a density of $1.75 \times 10^4$ cells/well overnight. Two-fold serial dilutions of heat inactivated serum samples were prepared and mixed with 50 μL of pseudovirus. The mixture was incubated at 37° C. for 1 hour before adding to HEK293T-hACE2 cells. Forty-eight hours after infection, cells were lysed in STEADY-GLO® Luciferase Assay (Promega) according to the manufacturer's instructions. 2019-nCoV neutralization titers were defined as the sample dilution at which a 50% reduction in RLU was observed relative to the average of the virus control wells.

Live virus neutralization assay. A full-length 2019-nCoV virus based on the Seattle Washington isolate was designed to express luciferase and GFP and was recovered via reverse genetics and described previously (11, 12). The virus was titered in Vero E6 USAMRID cells to obtain a relative light units (RLU) signal of at least 10× the cell only control background. Vero E6 USAMRID cells were plated at 20,000 cells per well the day prior in clear bottom black walled 96-well plates. Neutralizing antibody serum samples were tested at a starting dilution of 1:40 and were serially diluted 4-fold up to eight dilution spots. Antibody-virus complexes were incubated at 37° C. with 5% CO2 for 1 hour. Following incubation, growth media was removed and virus-antibody dilution complexes were added to the cells in duplicate. Virus-only controls and cell-only controls were included in each neutralization assay plate. Following infection, plates were incubated at 37° C. with 5% $CO_2$ for 48 hours. After the 48 h incubation, cells were lysed and luciferase activity was measured via Nano-Glo Luciferase Assay System (Promega) according to the manufacturer specifications. 2019-nCoV neutralization titers were defined as the sample dilution at which a 50% reduction in RLU was observed relative to the average of the virus control wells.

Systems serology. For the functional analysis of plasma samples, bead-based assays were used to quantify antibody-dependent cellular phagocytosis (ADCP), antibody-dependent neutrophil phagocytosis (ADNP) and antibody-dependent complement deposition (ADCD), as previously described (13). Protein antigens included receptor binding domain (RBD; courtesy Aaron Schmidt, Ragon Institute and MassCPR), prefusion stabilized Spike ectodomain (S; courtesy Bing Chen, Children's Hospital and MassCPR), and nucleocapsid (N; Sino Biological). Fluorescent streptavidin beads (Thermo Fisher) were coupled to biotinylated RBD, N and S and incubated with diluted plasma (ADCP and ADNP 1:100, ADCD 1:10). For ADCP, THPs were added to the immune complexes and incubated for 16h at 37° C. For ADNP, primary neutrophils were isolated using ammonium-chlor-ide potassium (ACK) lysis buffer from whole blood. After 1h incubation at 37° C., neutrophils were stained with an anti-CD66b PacBlue detection antibody (Biolegend). For the ADCD assay, lyophilized guinea pig complement (Cedarlane) was resuspended according to manufacturer's instructions and diluted in gelatin veronal buffer with calcium and magnesium (Boston BioProducts). Post incubation, C3 was detected with Fluorescein-Conjugated Goat IgG Fraction to Guinea Pig Complement C3 (Mpbio). For detection of antibody-dependent NK cell activity, an ELISA-based approach was used. Briefly, plates were coated with 3 ug/mL of antigen (as mentioned above) and samples were added at a 1:50 dilution and incubated for 2h at 37° C. NK cells were isolated the day prior via RosetteSep (Stem Cell Technologies) from healthy buffy coats and rested overnight in 1 ng/mL IL-15 (Stemcell). NK cells were incubated with immune complexes for 5h at 37° C. with a staining cocktail containing CD107a PE-Cy5 (BD), Golgi stop (BD) and Brefeldin A (BFA, Sigma Aldrich). Post NK cell incubation, cells were fixed (Perm A, Life Tech) and stained for surface markers with anti-CD16 APC-Cy7 (BD), anti-CD56 PE-Cy7 (BD) and anti-CD3 PacBlue (BD) while fixing. Post permeabilization with Perm B (Life Tech), anti-IFN-gamma FITC (BD) and anti-MIP-1β PE (BD) antibodies were used for intracellular staining. All assays were acquired via flow cytometry with an iQue (Intellicyt) and an S-Lab robot (PAA). For ADCP, events were gated on bead-positive cells, whereas neutrophils were defined as CD66b positive followed by gating on bead-positive neutrophils. A phagocytosis score was calculated for ADCP and ADNP as (percentage of bead-positive cells) x (MFI of bead-positive cells) divided by 10000. ADCD was reported as MFI of C3 deposition. NK cells were defined as CD3-, CD16+ and CD56+. Data were reported as percentage of cells positive for CD107a, MIP-1-alpha or IFN-gamma.

ELISPOT assay. ELISPOT plates were coated with mouse anti-human IFN-γ monoclonal antibody from BD Pharmingen at a concentration of 5 pg/well overnight at 4° C. Plates were washed with DPBS containing 0.25% Tween20, and blocked with R10 media (RPMI with 11% FBS and 1.1% penicillin-streptomycin) for 1 h at 37° C. Spike 1 and Spike 2 peptide pools were prepared at a concentration of 2 pg/well, and 200,000 cells/well were added. The peptides and cells were incubated for 18-24 h at 37° C. All steps following this incubation were performed at room temperature. The plates were washed with coulter buffer and incubated for 2 h with Rabbit polyclonal anti-human IFN-γ Biotin from U-Cytech (1 μg/mL). The plates are washed a second time and incubated for 2 h with Streptavidin-alkaline phosphatase antibody from Southern Biotechnology (1 μg/mL). The final wash was followed by the addition of Nitor-blue Tetrazolium Chloride/5-bromo-4-chloro 3'indolyl phosphate p-toludine salt (NBT/BCIP chromagen) substrate solution for 7 minutes. The chromagen was discarded and the plates were washed with water and dried in a dim place for 24 hours. Plates were scanned and counted on a Cellular Technologies Limited Immunospot Analyzer.

Intracellular cytokine staining assay. $10^6$ PBMCs/well were re-suspended in 100 μL of R10 media supplemented with CD49d monoclonal antibody (1 μg/mL). Each sample was assessed with mock (100 μL of R10 plus 0.5% DMSO; background control), Spike 1 and Spike 2 peptide pools (2 μg/mL), or 10 μg/mL phorbol myristate acetate (PMA) and 1 μg/mL ionomycin (Sigma-Aldrich) (100 μL; positive control) and incubated at 37° C. for 1 h. After incubation, 0.25 μL of GolgiStop and 0.25 μL of GolgiPlug in 50 μL of R10 was added to each well and incubated at 37° C. for 8 h and then held at 4° C. overnight. The next day, the cells were washed twice with DPBS, stained with Near IR live/dead dye for 10 mins and then stained with predetermined titers of mAbs against CD279 (clone EH12.1, BB700), CD38 (clone OKT10, PE), CD28 (clone 28.2, PE CY5), CD4 (clone L200, BV510), CD45 (clone D058-1283, BUV615), CD95 (clone DX2, BUV737), CD8 (clone SKI, BUV805), for 30 min. Cells were then washed twice with 2% FBS/DPBS buffer and incubated for 15 min with 200 μL of BD CytoFix/CytoPerm Fixation/Permeabilization solution. Cells were washed twice with 1× Perm Wash buffer (BD Perm/Wash™ Buffer 10× in the CytoFix/CytoPerm Fixation/Permeabilization kit diluted with MilliQ water and passed through 0.22 μm filter) and stained with intracellularly with mAbs against Ki67 (clone B56, FITC), CD69 (clone TP1.55.3, ECD), 11_10 (clone JES3-9D7, PE CY7), 103 (clone JES10-5A2, BV421), TNF-α (clone Mab11, BV650), IL4 (clone MP4-2502, BV711), IFN-γ (clone B27; BUV395), IL2 (clone MQ1-17H12, APC), CD3 (clone SP34.2, Alexa 700), for 30 min. Cells were washed twice with 1× Perm Wash buffer and fixed with 250 μL of freshly prepared 1.5% formaldehyde. Fixed cells were transferred to 96-well round bottom plate and analyzed by BD FACSymphony™ system.

Histopathology and immunohistochemistry. Tissues were fixed in freshly prepared 4% paraformaldehyde for 24 hours, transferred to 70% ethanol, and paraffin embedded within 7 days and blocks sectioned at 5 μm. Slides were baked for 30-60 min at 65 degrees then deparaffinized in xylene and rehydrated through a series of graded ethanol to distilled water. For SARS-N and Iba-1 IHC, heat induced epitope retrieval (HIER) was performed using a pressure cooker on steam setting for 25 minutes in citrate buffer (Thermo; AP-9003-500) followed by treatment with 3% hydrogen peroxide. Slides were then rinsed in distilled water and protein blocked (BioCare, BE965H) for 15 min followed by rinses in 1× phosphate buffered saline. Primary rabbit anti-SARS-nucleoprotein antibody (Novus; NB100-56576) and rabbit anti-Iba-1 antibody (Wako; 019-19741) was applied at 1:250 followed by rabbit Mach-2 HRP-Polymer (BioCare; RHRP520L) for 30 minutes then counterstained with hematoxylin followed by bluing using 0.25% ammonia water. Labeling for SARS-N and Iba-1 were performed on a Biogenex 16000 Autostainer (v3.02). CD4+ T cell, macrophage (CD68/CD163), neutrophil (MPO), and type 1 IFN response (Mx1) IHC was performed as previously describe using a Biocare intelliPATH autostainer (14), with all antibodies being incubated for 1 h at room temperature. CD4 (abcam Cat. No. ab133616; clone EPR6855) was used at 1:200 detection using Rabbit Polink-1 HRP (GBI Labs Cat. No. D13-110), CD68 (Biocare Cat. No. CM033C; clone KP1) was used at 1:400 detection using Mouse Polink-2 AP (GBI Labs Cat. No. D69-110), CD163 (Thermo Cat. No. MA5-11458; clone 10D6) was used at 1:400 detection using Mouse Polink-2 AP (GBI Labs Cat. No. D69-110), MPO (Dako Cat. No. A0398; polyclonal) was used at 1:1000 detection using Rabbit Polink-1 HRP (GBI Labs Cat. No. D13-110), Mx1 (EMD Millipore Cat. No. MABF938; clone M143/CL143) was used at 1:1000 detection using Mouse Polink-2 HRP (GBI Labs Cat. No. D37-110). Tissue pathology was assessed independently by two board-certified veterinary pathologists (AJM and ADM). Quantitative image analysis was performed using HALO software (v2.3.2089.27; Indica Labs). For SARS CoV-2 infected animals (n=4) four regions each of the left and right lung were analyzed and for uninfected controls (n=4) one region was analyzed. For Mx1 quantification, the Area Quantification v2 module was used to determine the percentage of MX1 protein as a proportion of the total tissue area. For MPO (neutrophil) quantification, the HALO AI software was first trained to detect the alveolar portion of the lung by excluding blood vessels (>5 $mm^2$), bronchi, bronchioles, cartilage, and connective tissue; subsequently, the CytoNuclear v1.6 module was used to detect MPO+ cells and is presented as a proportion of total alveolar tissue (PMNs/$mm^2$). In all instances, manual curation was performed on each sample to ensure the annotations were accurate and to correct false positives/false negatives.

RNASCOPE® in situ hybridization. RNASCOPE® in situ hybridization was performed as previously described (15) using 2019-nCoV anti-sense specific probe v-nCoV2019-S (ACD Cat. No. 848561) targeting the positive-sense viral RNA, 2019-nCoV sense specific probe v-nCoV2019-orf1ab-sense (ACD Cat. No. 859151) targeting the negative-sense genomic viral RNA, and ZIKA probe V-ZIKVsph2015 (ACD Cat. No. 467871) as a negative control. In brief, after slides were deparaffinized in xylene and rehydrated through a series of graded ethanol to distilled water, retrieval was performed for 30 min in ACD P2 retrieval buffer (ACD Cat. No. 322000) at 95-98° C., followed by treatment with protease III (ACD Cat. No.

322337) diluted 1:10 in PBS for 20 min at 40° C. Slides were then incubated with 3% H2O2 in PBS for 10 minutes at room temperature. Prior to hybridization, probes stocks were centrifuged at 13,000 rpm using a microcentrifuge for 10 min, then diluted 1:2 in probe diluent (ACD Cat. No. 300041) to reduce probe aggregation tissue artifacts. Slides were developed using the RNASCOPE® 2.5 HD Detection Reagents-RED (ACD Cat. No. 322360).

Cyclic immunofluorescence. Cyclic Immunofluorescence (CyCIF) was performed as previously described (16). Briefly, paraformaldehyde fixed specimens on glass slides were dewaxed and antigen retrieval performed on a Leica Bond RX. Slides were then subjected to CyCIF using the following antibodies (Table 1). Slides were scanned with a RARECYTE® CYTEFINDER® scanner equipped with a 20×, 0.8 NA objective and images then corrected for uneven illumination using the BaSiC tool. Flat-field-corrected images were processed using ASHLAR software to align images and channels to each other across all cycles.

TABLE 1

Antibodies for Tissue Cyclic Immunofluorescence

| Target | Fluorochrome | Species | Clone | Vendor | Catalog No | Dilution | [Ab] (µg/mL) |
|---|---|---|---|---|---|---|---|
| CD16 | ALEXA FLUOR ®647 | Mouse | DJ130c | Santa Cruz Biotechnologies | sc-20052 AF647 | 150 | 1.3 |
| CD20 | eFluor 660 | Mouse | L26 | Thermo Fisher | 50-0202-80 | 1000 | 0.2 |
| CD206 | ALEXA FLUOR ®488 | Mouse | D-1 | Santa Cruz Biotechnologies | sc-376108 AF488 | 150 | 1.3 |
| CD31 | ALEXA FLUOR ®647 | Rabbit | EPR3094 | Abcam | ab218582 | 300 | n.d. |
| CD3E | n/a | Rat | CD3-12 | Abcam | ab11089 | 100 | 2 |
| CD68 | Phycoerythrin | Rabbit | D4B9C | CST | 79594S | 200 | n.d. |
| ECAD | ALEXA FLUOR ®488 | Rabbit | clone 24E10 | CST | 3199S | 300 | n.d. |
| HLADR | ALEXA FLUOR ®555 | Rabbit | EPR3692 | Abcam | ab215312 | 500 | n.d. |
| IBA1 | ALEXA FLUOR ®488 | Rabbit | EPR6136(2) | Abcam | ab195031 | 200 | n.d. |
| MPO | ALEXA FLUOR ®488 | Rabbit | EPR20257 | Abcam | ab225474 | 400 | n.d. |
| pan-CK | eFluor 570 | Mouse | AE1/AE3 | Thermo Fisher | 41-9003-82 | 1000 | 0.2 |
| Rabbit IgG | ALEXA FLUOR ®488 | Goat | polyclonal | Thermo Fisher | A11070 | 2000 | 1 |
| Rat IgG | ALEXA FLUOR ®555 | Goat | polyclonal | Thermo Fisher | A21245 | 2000 | 1 |
| SARS-N | n/a | Rabbit | polyclonal | Novus | NB100-56576 | 200 | 2.5 |

Statistical analyses. Analysis of virologic and immunologic data was performed using GraphPad Prism 8.4.2 (GraphPad Software). Comparison of data between groups was performed using 2-sided Mann-Whitney tests. P-values of less than 0.05 were considered significant.

Results

Figure 23A:
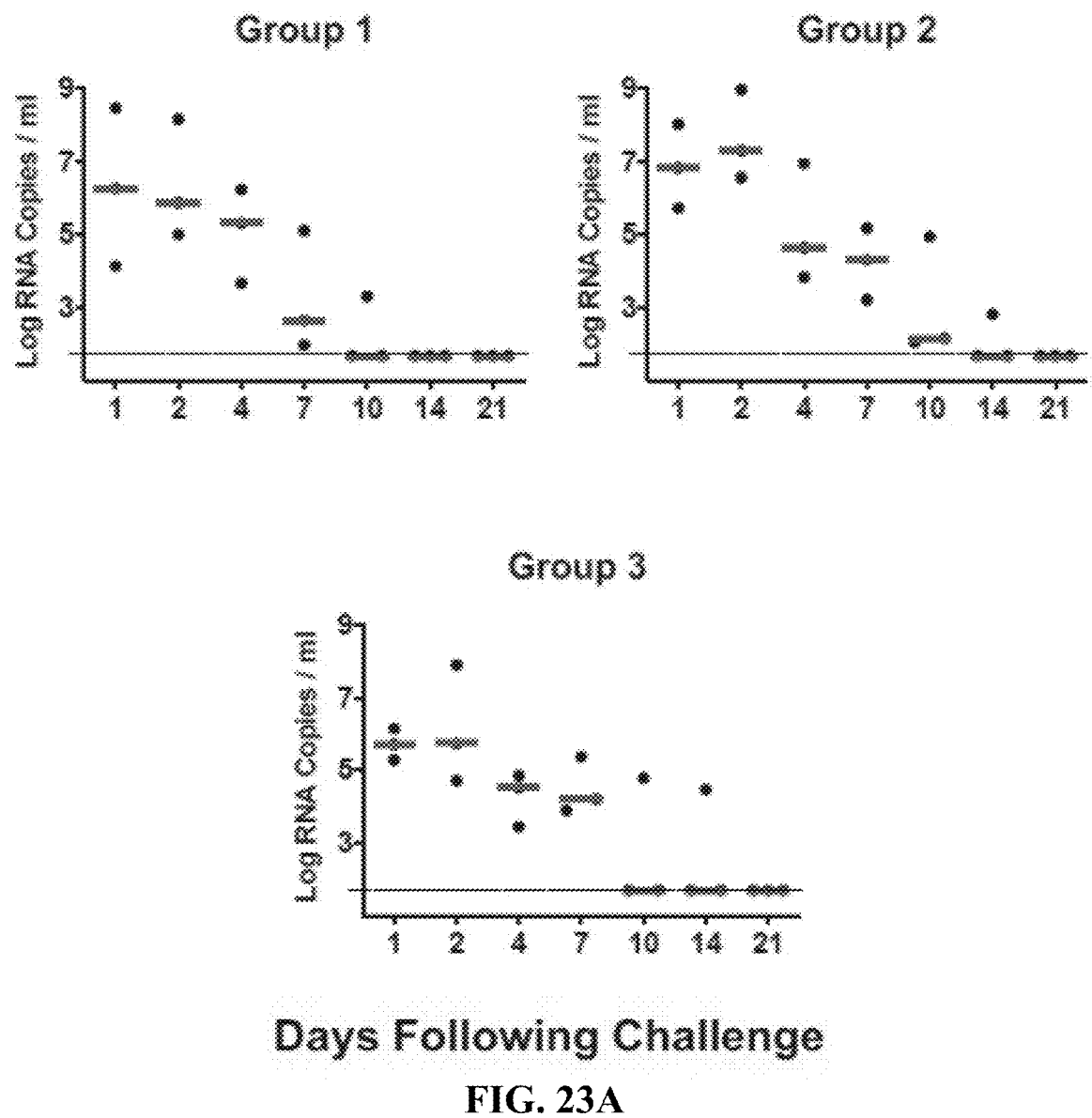
FIGS. 23A-23C are graphs showing viral loads in 2019-nCoV challenged rhesus macaques. Rhesus macaques were inoculated by the intranasal and intratracheal route with $1.1 \times 10^6$ PFU (Group 1; N=3), $1.1 \times 10^5$ PFU (Group 2; N=3), or $1.1 \times 10^4$ PFU (Group 3; N=3) 2019-nCoV.
Figure 23B:
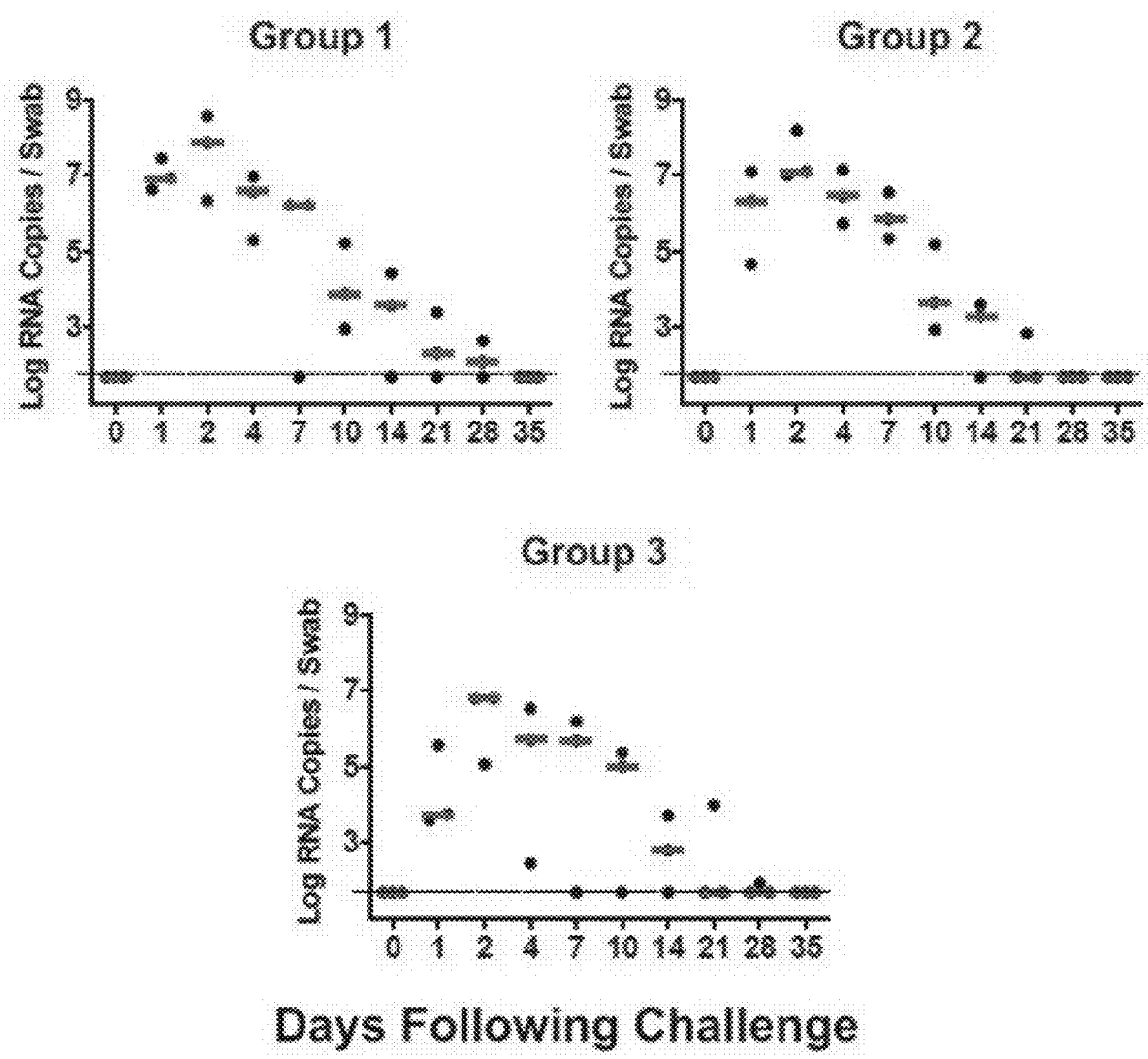
Figure 30:
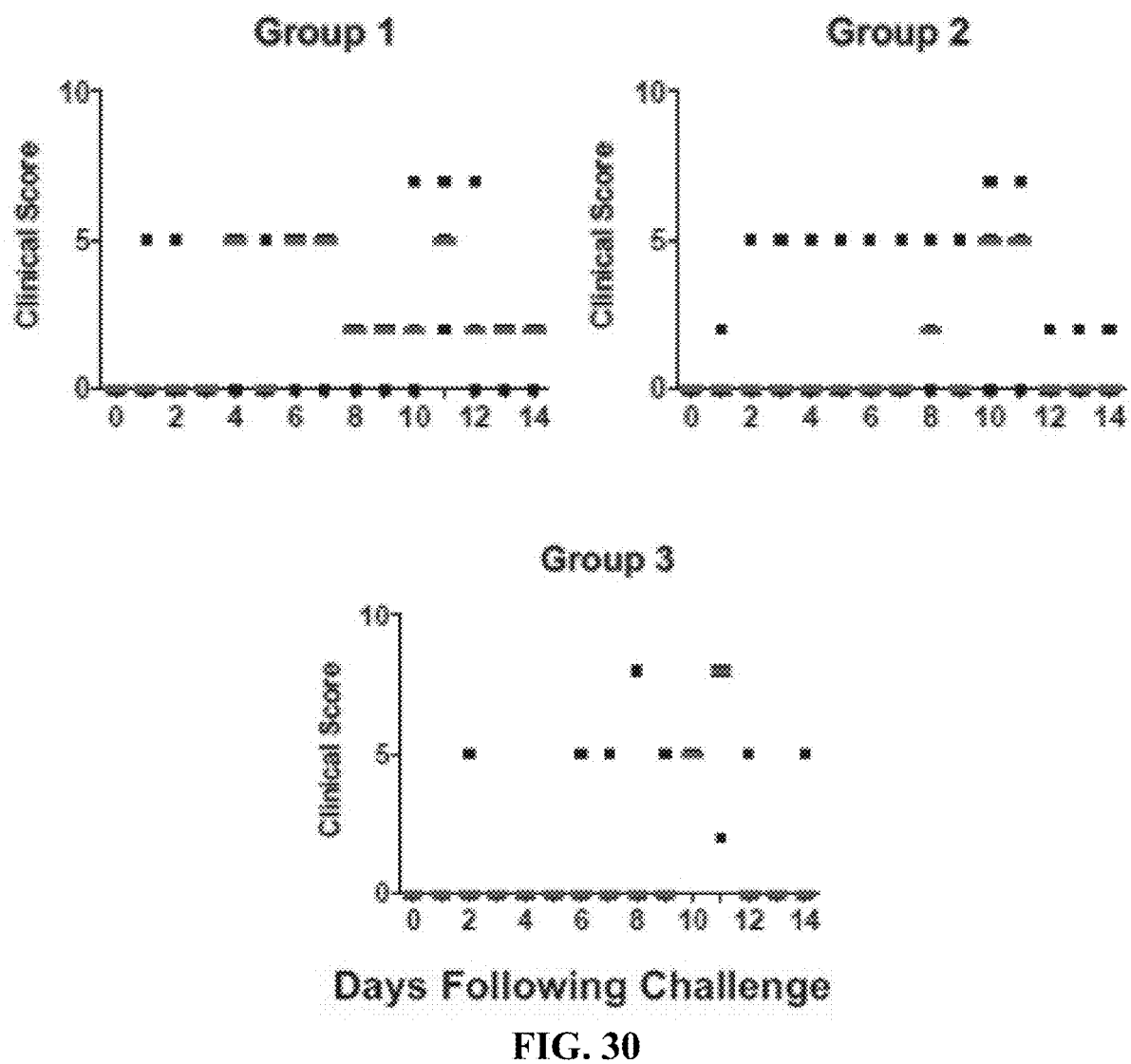
FIG. 30 is a series of graphs showing clinical scores of 2019-nCoV challenged rhesus macaques. Groups 1-3 are described in FIG. 23. Semi-quantitative clinical scoring of animals based on appearance, dyspnea, recumbency, appetite, and responsiveness. respiratory distress at multiple timepoints following challenge. Red horizontal bars reflect median clinical scores.
Figure 31:
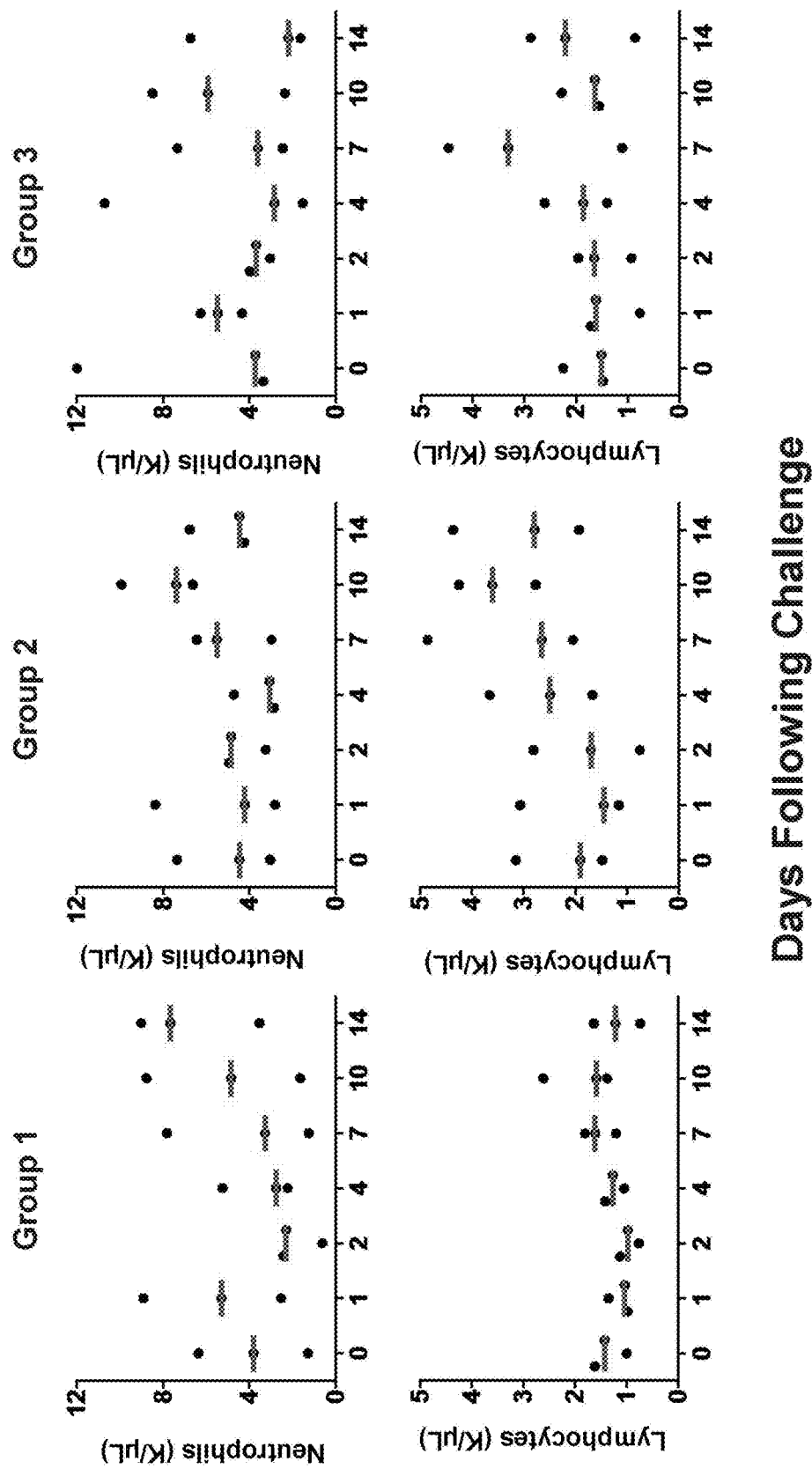
FIG. 31 is a graph showing hematology in 2019-nCoV challenged rhesus macaques. Neutrophil and lymphocyte counts (K/μL) are shown. Red horizontal bars reflect median values.

Virology and Immunology of 2019-nCoV Infection in Rhesus Macaques 9 adult rhesus macaques (6-12 years old) were inoculated with a total of $1.1 \times 10^6$ PFU (Group 1; N=3), $1.1 \times 10^5$ PFU (Group 2; N=3), or $1.1 \times 10^4$ PFU (Group 3; N=3) 2019-nCoV, administered as 1 ml by the intranasal (IN) route and 1 ml by the intratracheal (IT) route. Following viral challenge, viral RNA levels were assessed by RT-PCR in multiple anatomic compartments. High levels of viral RNA were observed in bronchoalveolar lavage (BAL) (FIG. 23A) and nasal swabs (NS) (FIG. 23B), with a median peak of 6.56 (range 5.32-8.97) $\log_{10}$ RNA copies/mL in BAL and a median peak of 7.00 (range 5.06-8.55) $\log_{10}$ RNA copies/swab in NS. Viral RNA in NS increased in all animals from day 1 to day 2, suggesting viral replication. Viral RNA peaked on day 2 and typically resolved by day 10-14 in BAL and by day 21-28 in NS. Following day 2, viral loads in BAL and NS appeared comparable in all groups regardless of dose. Viral RNA was undetectable in plasma (FIG. 29). Animals exhibited modestly decreased appetite and responsiveness suggestive of mild clinical disease (FIG. 30) as well as mild transient neutropenia and lymphopenia in the high dose group (FIG. 31), but fever, weight loss, respiratory distress, and mortality were not observed.

Figure 23C:
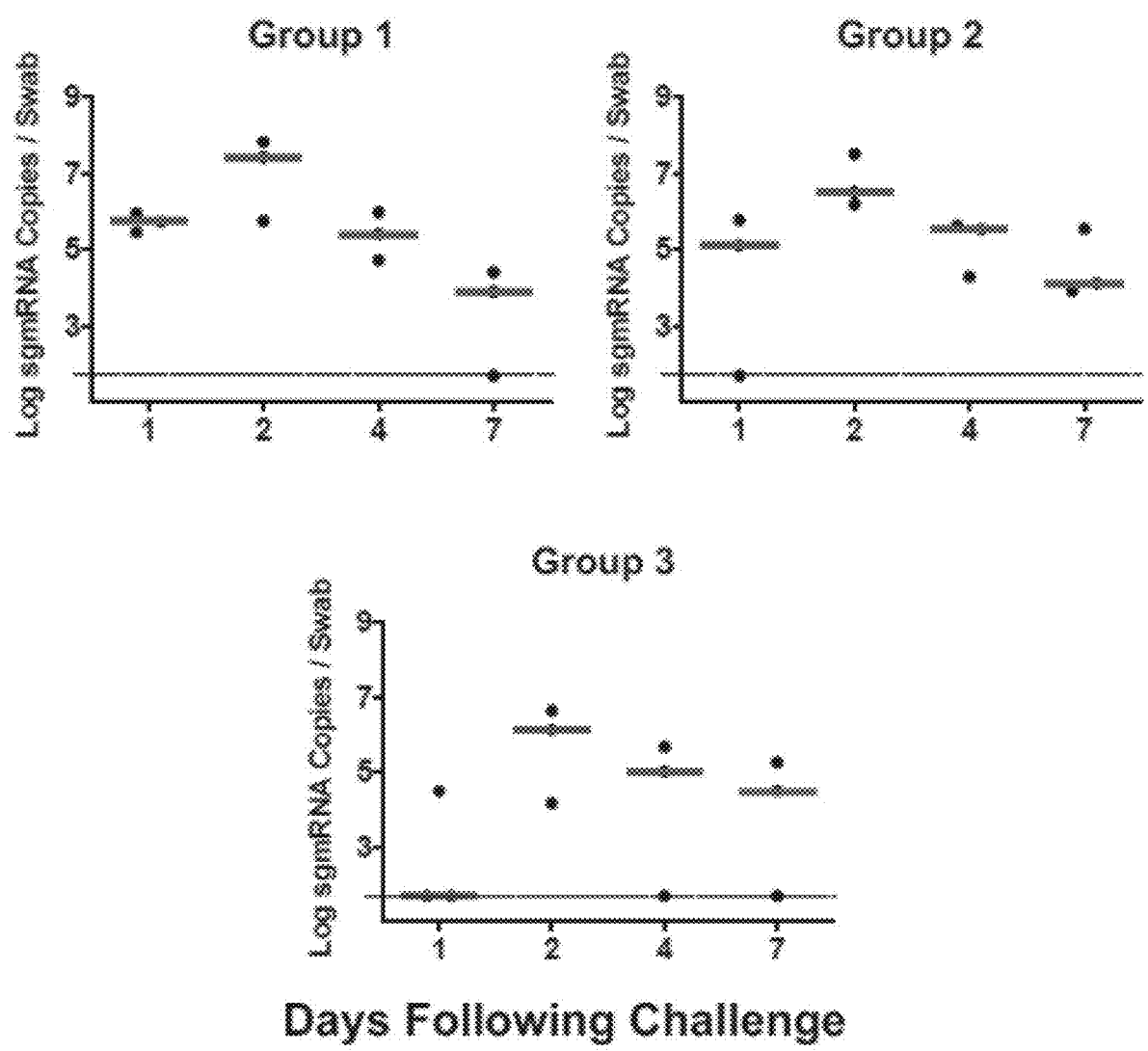

To help differentiate input challenge virus from newly replicating virus, an RT-PCR assay was developed to assess E gene subgenomic mRNA (sgmRNA). E gene sgmRNA reflects viral replication cellular intermediates that are not packaged into virions and thus represent putative replicating virus in cells (9). Compared with total viral RNA (FIG. 23B), sgmRNA levels were lower in NS on day 1 with a median of 5.11 (range <1.70-5.94) $\log_{10}$ sgmRNA copies/swab, but then increased by day 2 to a median of 6.50 (range 4.16-7.81) $\log_{10}$ sgmRNA copies/swab (FIG. 23C).

Figure 24A:
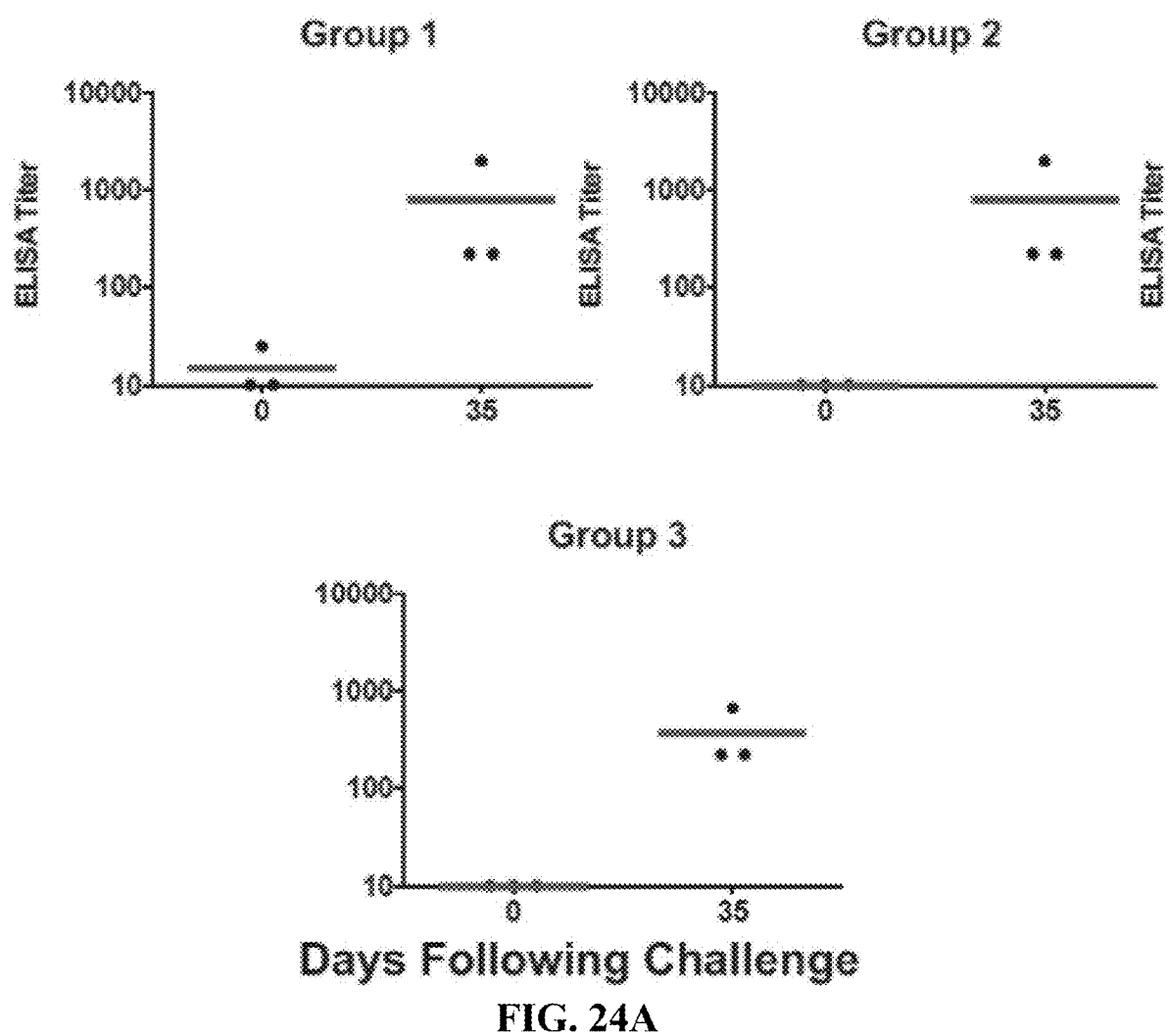
FIG. 24A-24F are graphs showing immune responses in 2019-nCoV challenged rhesus macaques. Humoral immune responses were assessed following challenge by (FIG. 24A) binding antibody ELISA, (FIG. 24B) pseudovirus neutralization assays, (FIG. 24C) live virus neutralization assays, and (FIG. 24D) systems serology profiles including antibody subclasses and effector functions to receptor binding domain (RBD), soluble spike (S) ectodomain, and nucleocapsid (N) proteins on day 35. Antibody-dependent complement deposition (ADCD), antibody-dependent cellular phagocytosis (ADCP), antibody-dependent neutrophil phagocytosis (ADNP), and antibody-dependent NK cell degranulation (NK CD107a) and cytokine secretion (NK MIP1β, NK IFNγ) are shown. Cellular immune responses were also assessed following challenge by (FIG. 24E) IFN-γ ELISPOT assays and (FIG. 24F) multiparameter intracellular cytokine staining assays in response to pooled S peptides. Red and horizontal bars reflect mean responses.
Figure 24B:
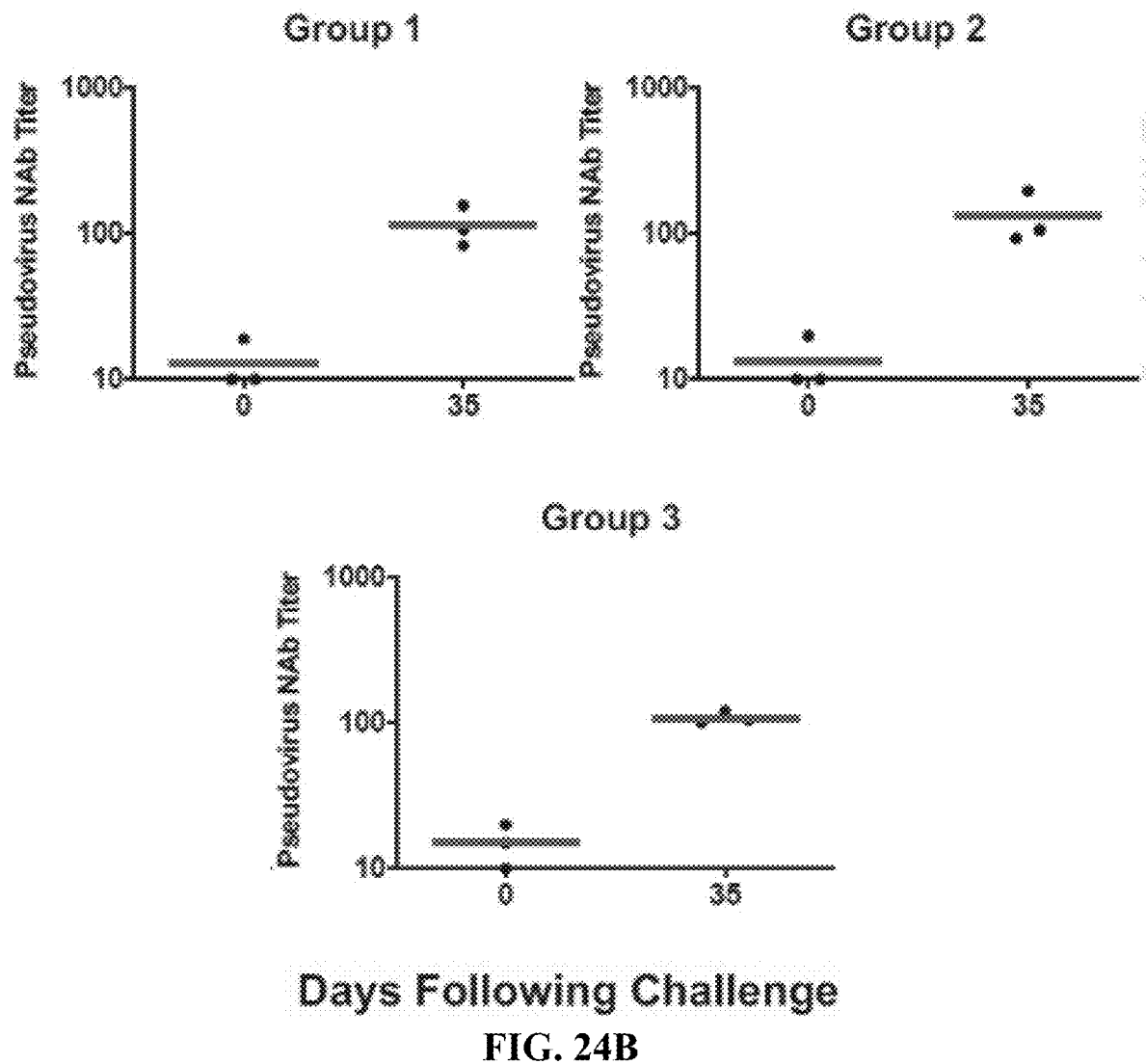
Figure 24C:
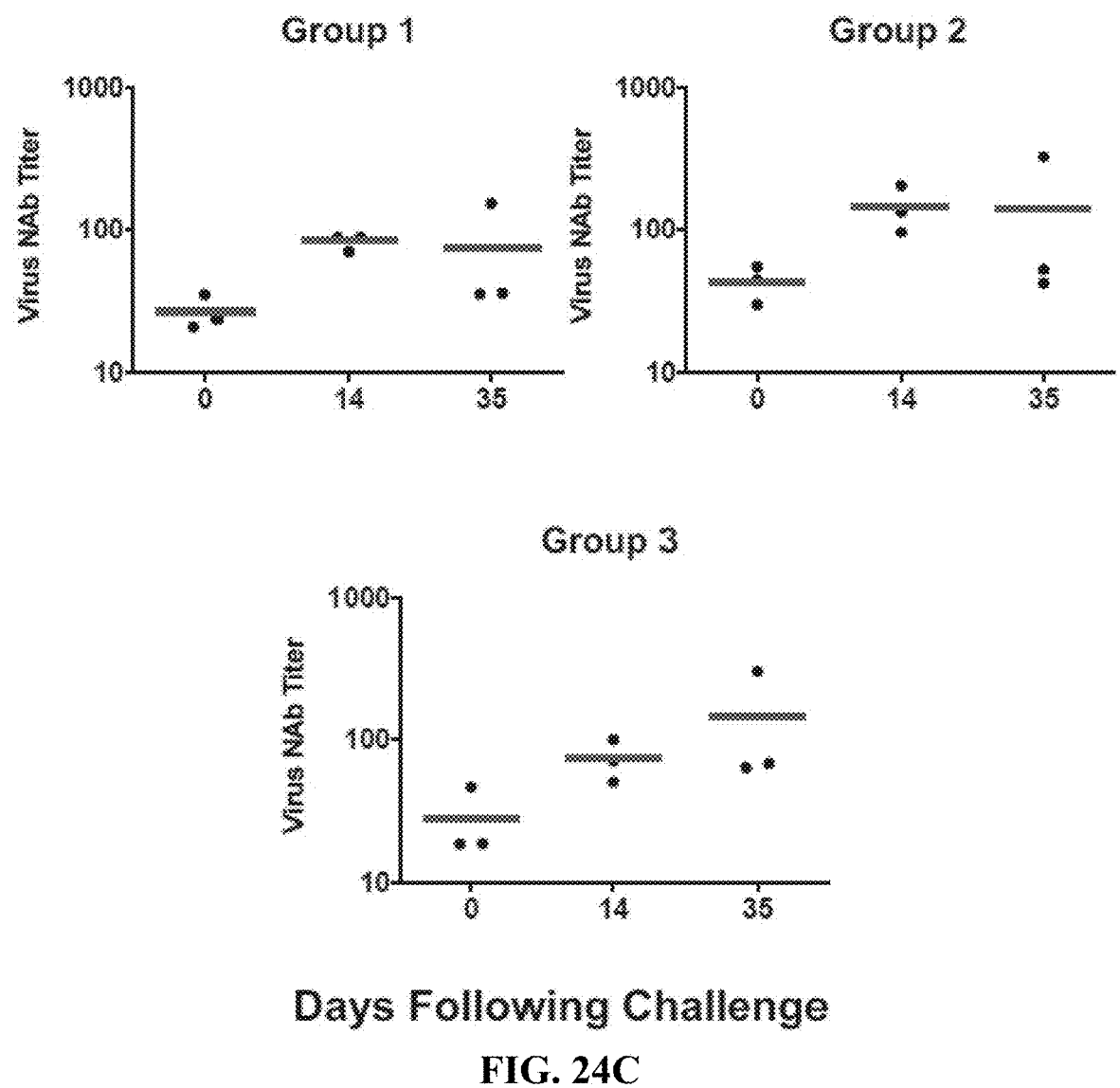
Figure 24D:
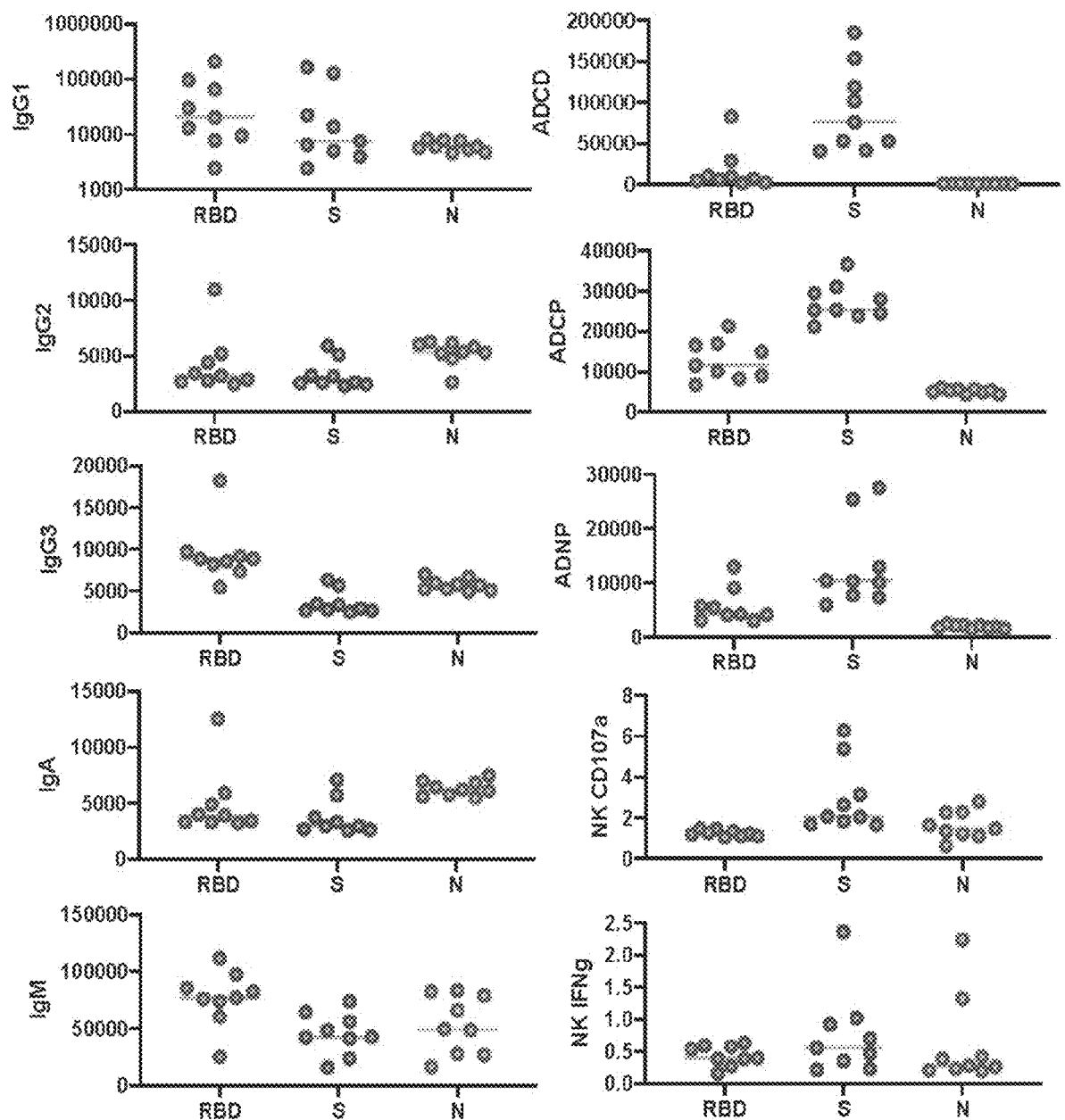
Figure 24E:
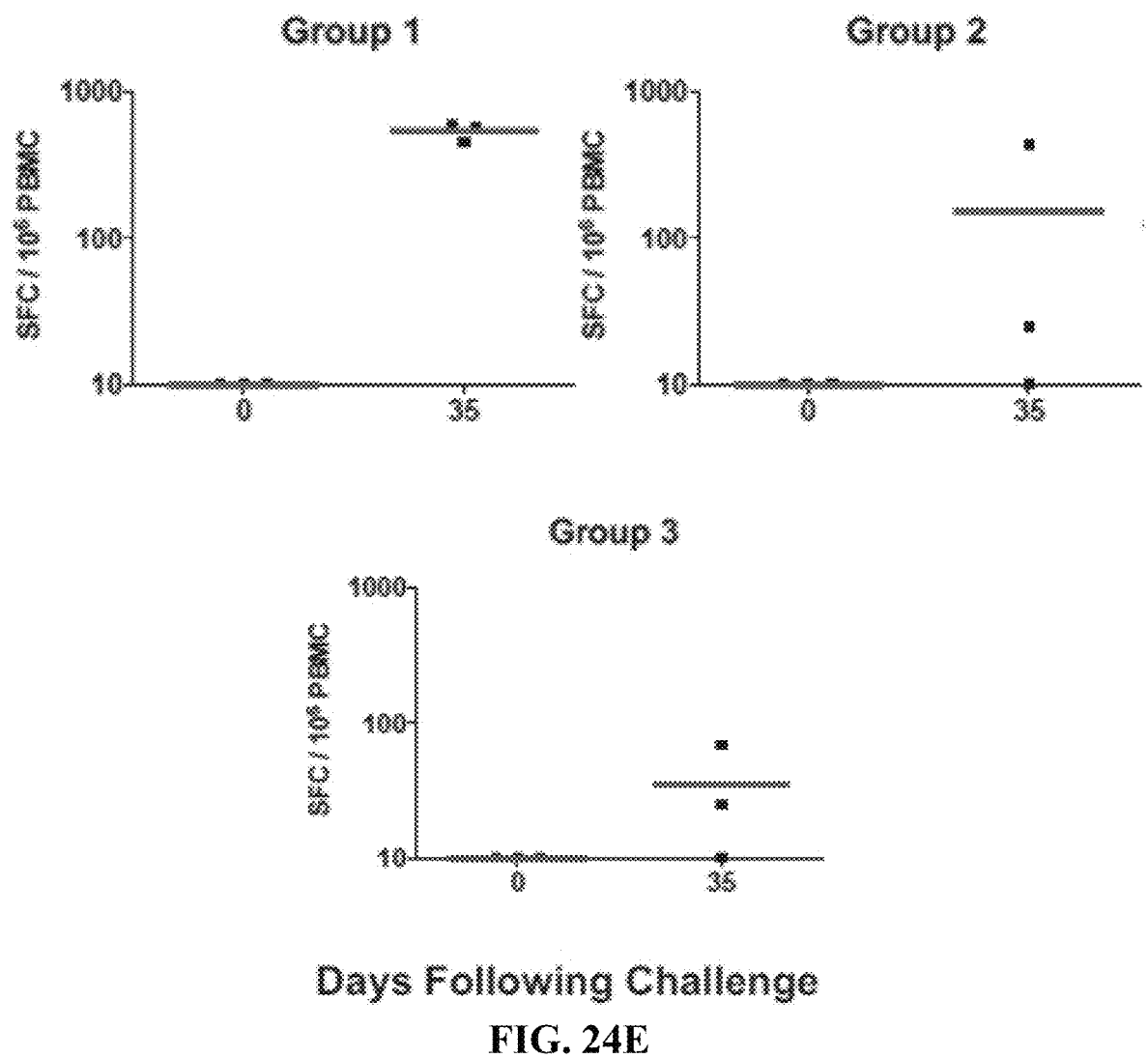
Figure 24F:
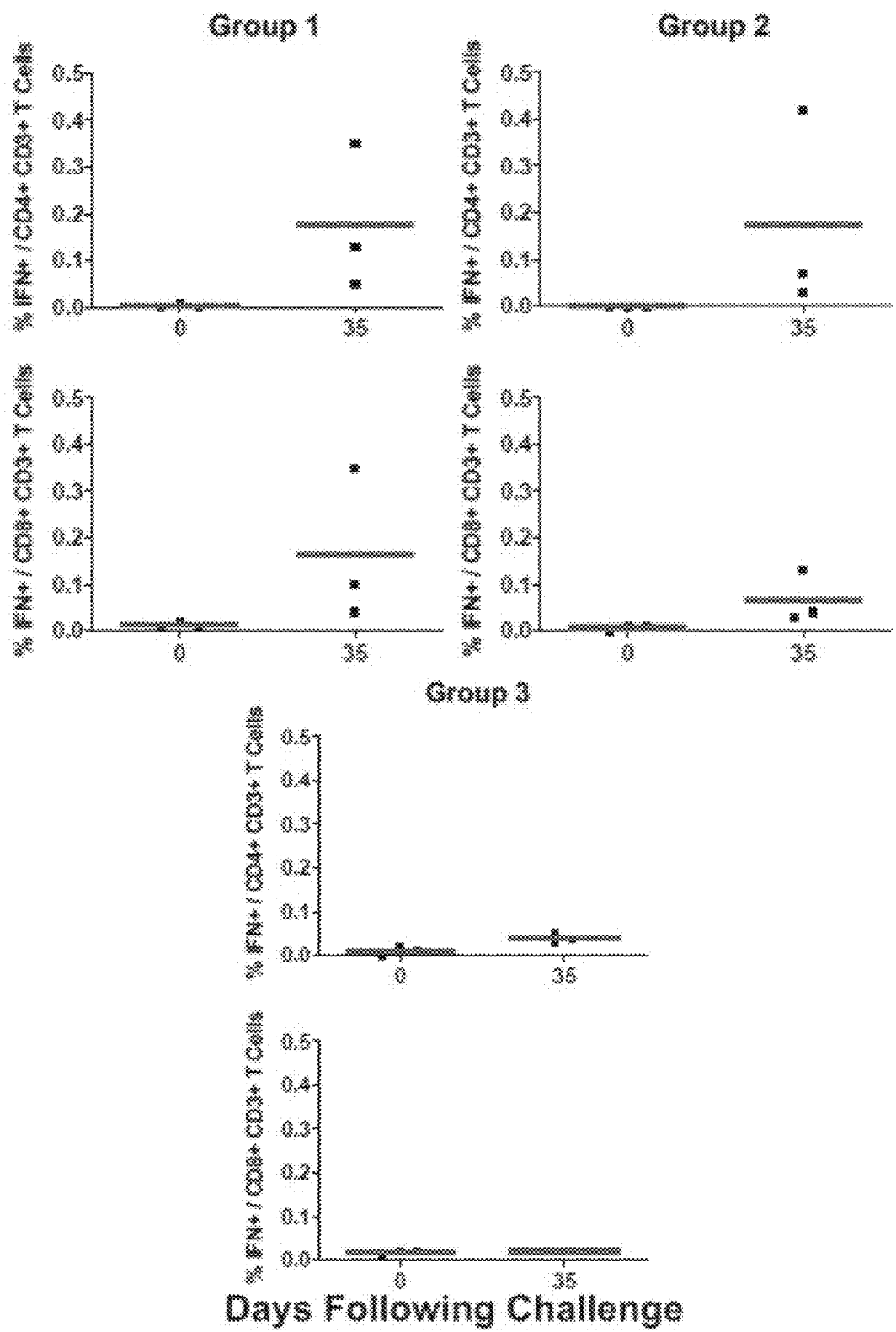

2019-nCoV-specific humoral and cellular immune responses in these animals was evaluated next. All 9 macaques developed binding antibody responses to the 2019-nCoV Spike (S) protein by ELISA (FIG. 24A) and neutralizing antibody (NAb) responses using both a pseudovirus neutralization assay (10) (FIG. 24B) and a live virus neutralization assay (11, 12) (FIG. 24C). NAb titers of approximately 100 were observed in all animals on day 35 regardless of dose group (range 83-197 by the pseudovirus neutralization assay and 35-326 by the live virus neutralization assay). Antibody responses of multiple subclasses were observed against the receptor binding domain (RBD), the prefusion S ectodomain (S), and the nucleocapsid (N), and antibodies exhibited diverse effector functions, including antibody-dependent complement deposition (ADCD), antibody-dependent cellular phagocytosis (ADCP), antibody-dependent neutrophil phagocytosis (ADNP), and antibody-dependent NK cell degranulation (NK CD107a) and cytokine secretion (NK MIP1β, NK IFNγ) (13) (FIG. 24D). Cellular immune responses to pooled S peptides were observed in the majority of animals by IFN-γ ELISPOT assays on day 35, with a trend towards lower responses in the lower dose groups (FIG. 24E). Intracellular cytokine staining assays demonstrated induction of both S-specific CD8+ and CD4+ T cell responses (FIG. 24F).

Figures 25A, 25B, 25C, 25D, 25E, 25F, 25G, 25H, 25I, 25J, 25K, 25L:
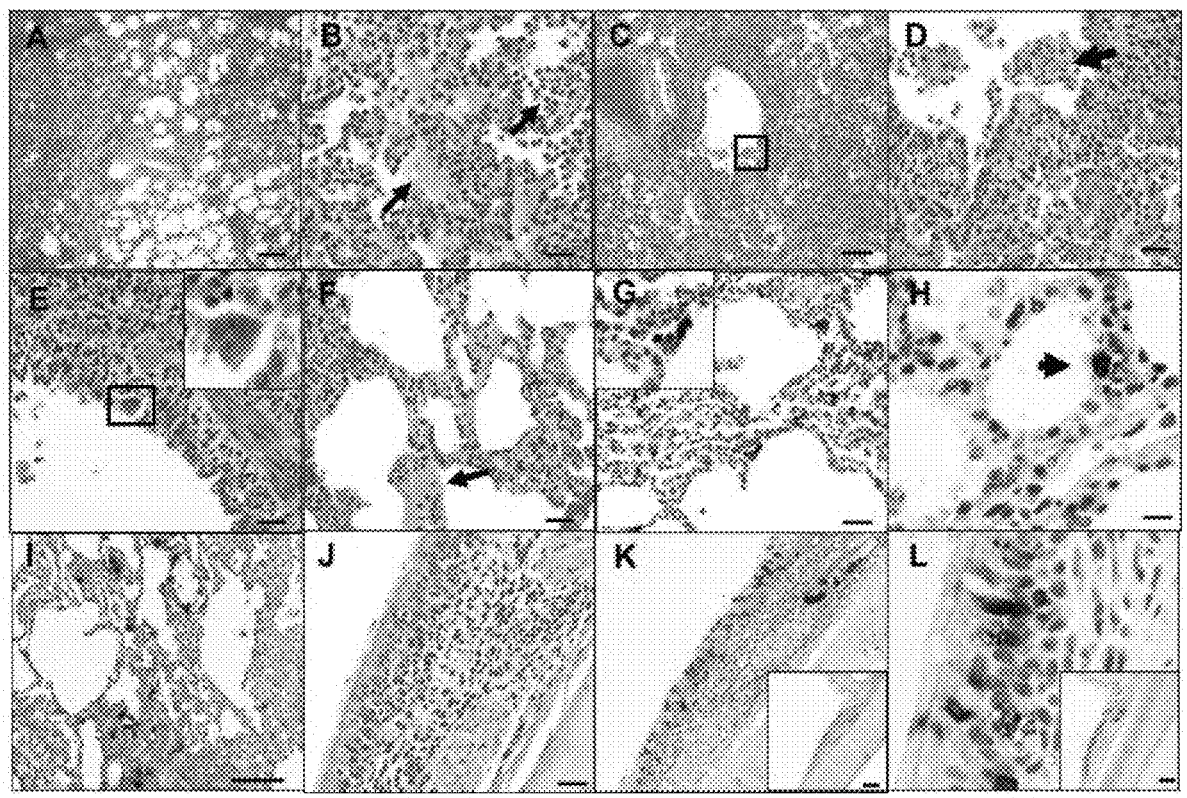
FIGS. 25A-25L is a set of micrographs showing that 2019-nCoV induces acute viral interstitial pneumonia.
Figure 32:
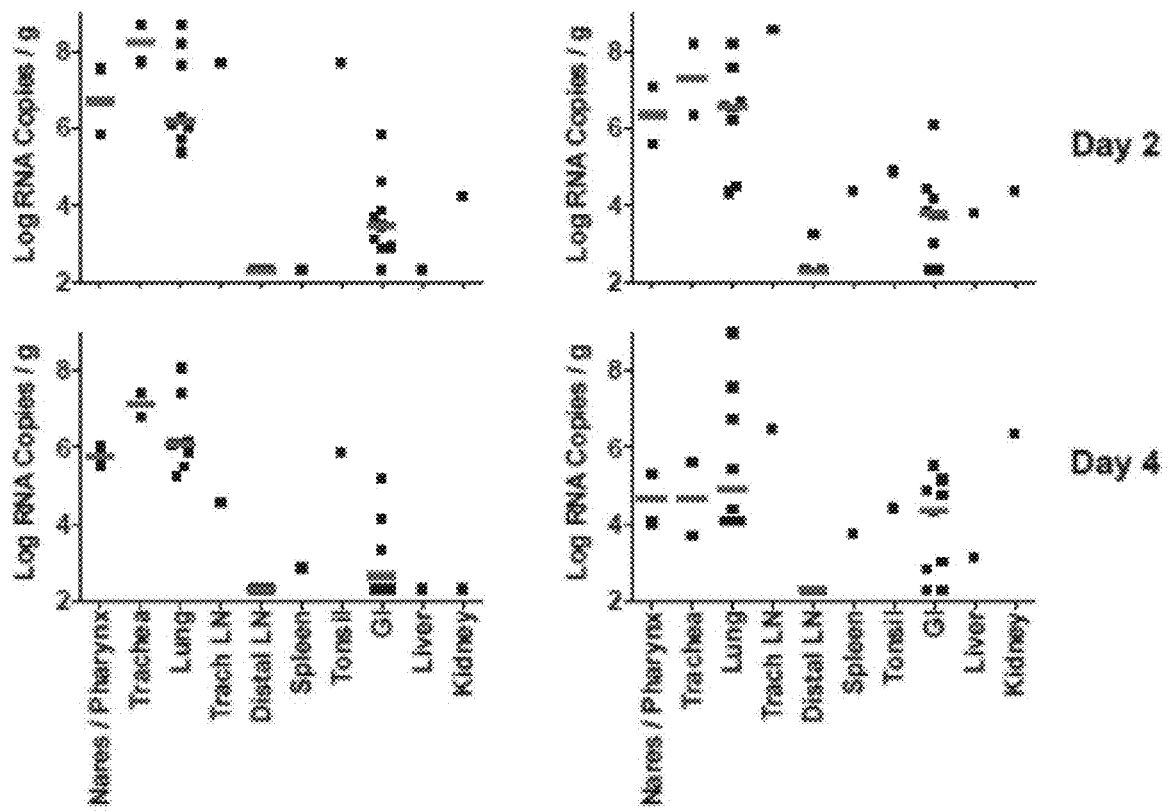
FIG. 32 is a graph showing tissue viral loads in 2019-nCoV challenged rhesus macaques. Rhesus macaques were inoculated with 2019-nCoV and were necropsied on day 2 (N=2) and day 4 (N=2) following challenge. $Log_{10}$ viral RNA copies/g tissue (limit 200 copies/g) were assessed in multiple tissues. Red horizontal bars reflect median viral loads.

SARS CoV-2 Infection Induces Acute Viral Interstitial Pneumonia in Rhesus Macaques Only limited pathology data from 2019-nCoV infected humans are currently available. To assess the pathologic characteristics of 2019-nCoV infection in rhesus macaques, 4 animals were inoculated with $1.1 \times 10^5$ PFU virus by the IN and IT routes as above and necropsied them on day 2 (N=2) and day 4 (N=2) following challenge. Multiple regions of the upper respiratory tract, lower respiratory tract, gastrointestinal tract, lymph nodes, and other organs were harvested for virologic and pathologic analyses. High levels of viral RNA were observed in all nasal mucosa, pharynx, trachea, and lung tissues, and lower levels of virus were found in the gastrointestinal tract, liver, and kidney (FIG. 32). Viral RNA was readily detected in paratracheal lymph nodes but was only sporadically found in distal lymph nodes and spleen (FIG. 32). Upper airway mucosae, trachea, and lungs were paraformaldehyde fixed, paraffin embedded, and evaluated by histopathology. On day 2 following challenge, both necropsied animals demonstrated multifocal regions of inflammation and evidence of viral pneumonia, including expansion of alveolar septae with mononuclear cell infiltrates, consolidation, and edema (FIG. 25A, 25B). Regions with edema also contained numerous polymorphonuclear cells, predominantly neutrophils. Terminal bronchiolar epithelium was necrotic and sloughed with clumps of epithelial cells detected within airways and distally within alveolar spaces (FIG. 25C, 25D) with formation of occasional bronchiolar epithelial syncytial cells (FIG. 25E). Hyaline membranes were occasionally observed within alveolar septa, consistent with damage to type I and type II pneumocytes (FIG. 25F). Diffusely reactive alveolar macrophages filled alveoli, and some were multinucleated and labeled positive for nucleocapsid by immunohistochemistry (FIG. 25G). Alveolar lining cells (pneumocytes) also prominently labeled positive for nucleocapsid (FIG. 25H).

Figures 33A, 33B, 33C, 33D, 33E, 33F, 33G, 33H, 33I, 33J:
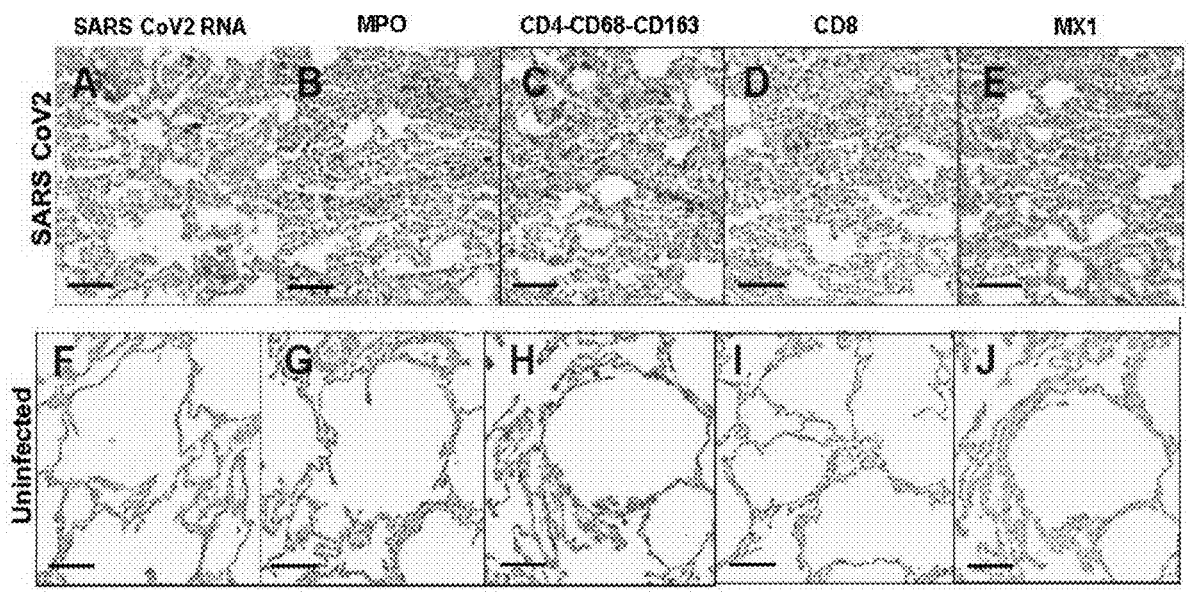
FIGS. 33A-33J are micrographs showing that 2019-nCoV replication induces polymorphonuclear and mononuclear inflammatory infiltrates associated with type 1 interferon responses.
Figure 34B:
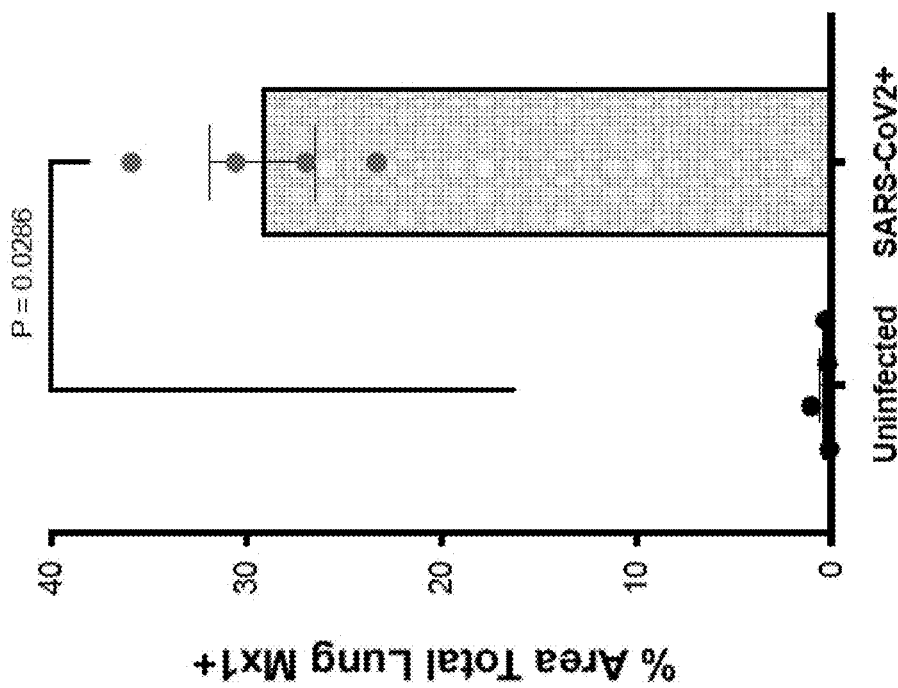
Figure 34A:
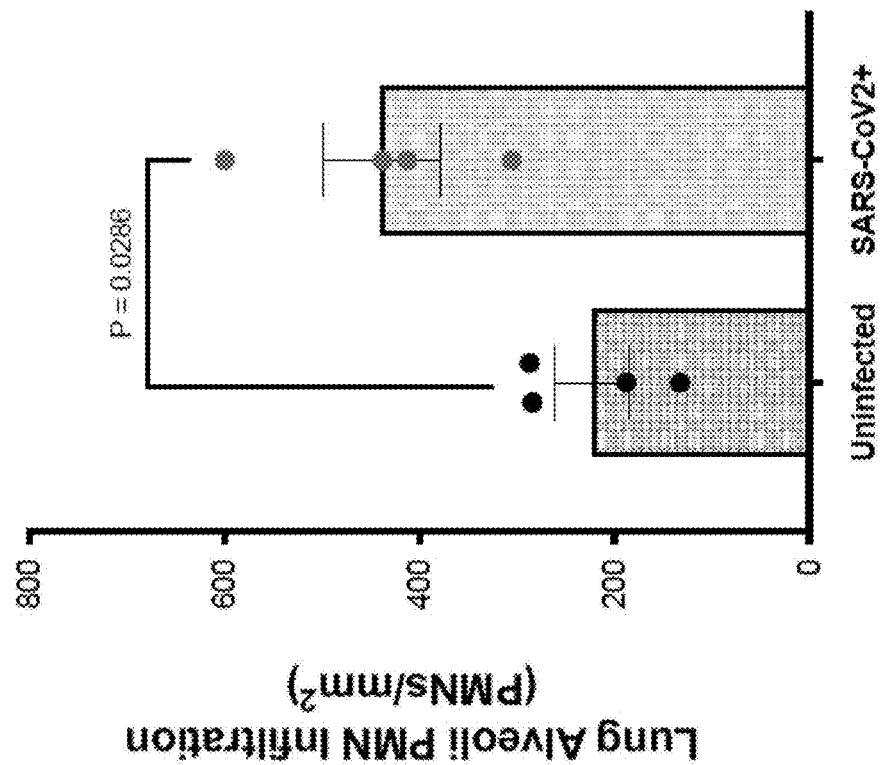

Multifocal clusters of virus infected cells were present throughout the lung parenchyma, as detected by immunohistochemistry and in situ RNA hybridization (RNAS-COPE®) (14, 15) (FIG. 25I). Both positive-sense and negative-sense viral RNA was observed by RNASCOPE®, suggesting viral replication in lung tissue. The dense inflammatory infiltrates included polymorphonuclear cells detected by endogenous myeloperoxidase staining (MPO), CD68 and CD163 positive macrophages, CD4+ and CD8+T lymphocytes, and diffuse upregulation of the type 1 interferon gene MX1 (FIG. 33). 2019-nCoV infection led to a significant increase in polymorphonuclear cell infiltration of lung alveoli compared with uninfected animals (P=0.0286) as well as extensive MX1 staining in approximately 30% of total lung tissue (P=0.0286) (FIG. 34). Inflammatory infiltrates were also detected in the respiratory epithelial submucosa of larger airways with transmigration of inflammatory cells into bronchiole lumen (FIG. 25J). Ciliated epithelial cells also stained positive for both SARS CoV-2 RNA (FIG. 25K) and SARS nucleocapsid (FIG. 25L). By day 4 following infection, the extent of inflammation and viral pneumonia had diminished, but virus was still detected in lung parenchyma and neutrophil infiltration and type 1 interferon responses persisted (FIG. 34).

Figures 26A, 26B, 26C, 26D:
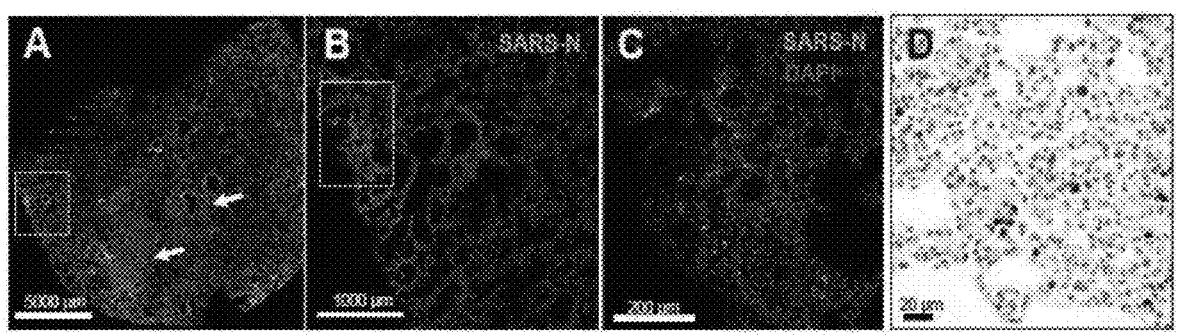
FIGS. 26A-26K is a set of micrographs showing that 2019-nCoV infects alveolar epithelial cells in rhesus macaques. Cyclic immunofluorescence (CyCIF) staining of fixed lung tissue from 2019-nCoV infected rhesus macaques 2 days following challenge.
Figures 26E, 26F, 26G, 26H, 26I, 26J, 26K:
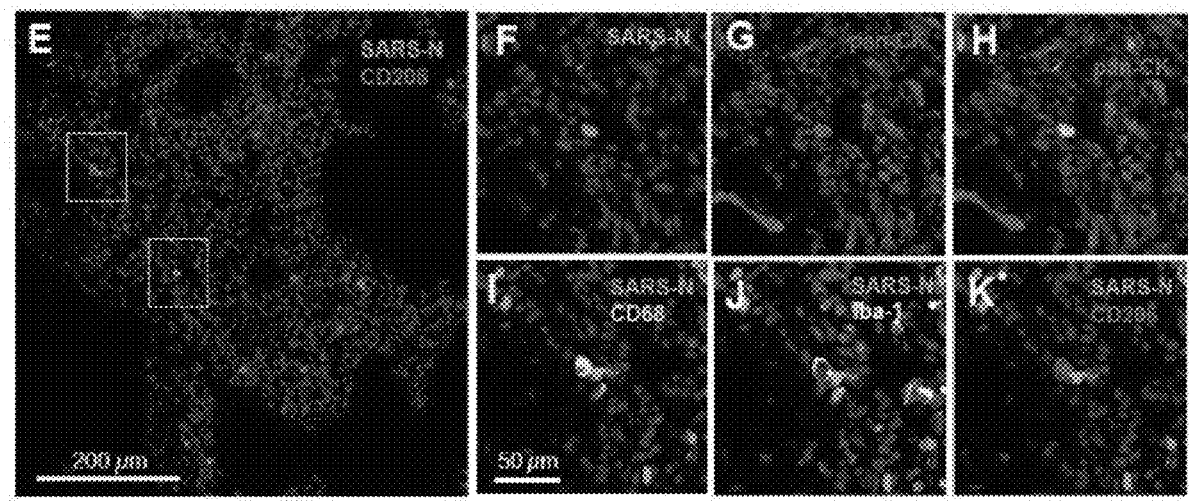
Figures 35A, 35B, 35C, 35D:
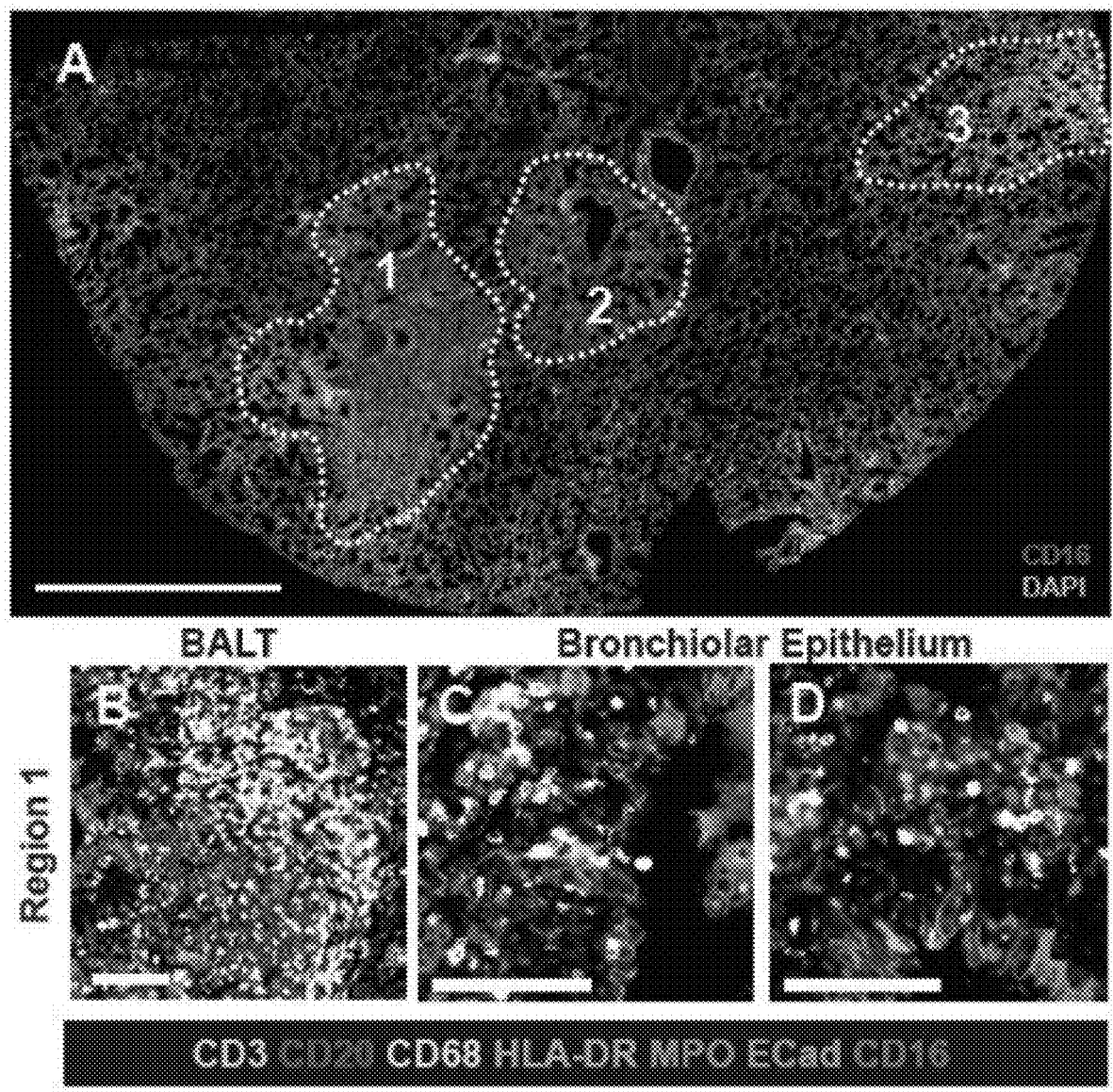
Figures 35E, 35F, 35G, 35H, 35I, 35J:
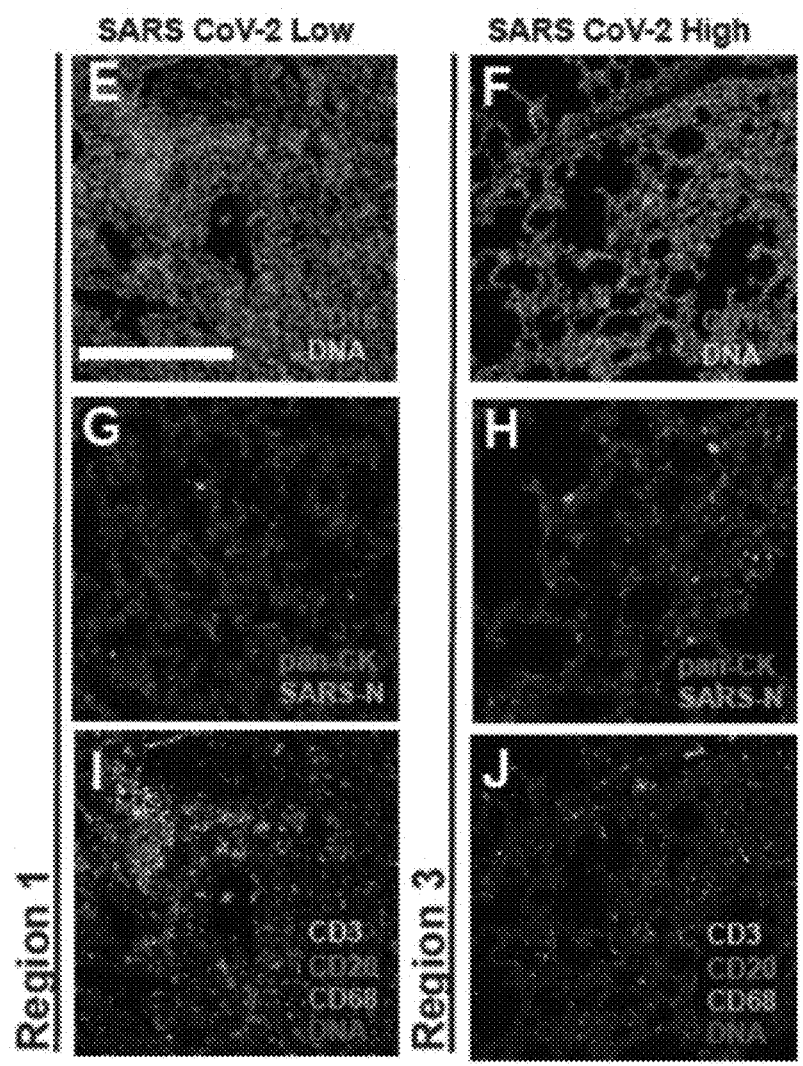

To further characterize infected tissues, cyclic immunofluorescence (CyCIF) imaging, a method for multiplex immunophenotyping of paraformaldehyde fixed tissue specimens (16), was performed. Tissues were stained for nucleocapsid (SARS-N), pan-cytokeratin (to identify epithelial cells), Iba-1 (ionized calcium binding adaptor as a pan-macrophage marker), CD68 (monocyte/macrophage marker), and CD206 (macrophage marker), in addition to a panel of markers to identify other immune cells and anatomical structures, and counterstaining for DNA to label all nuclei. Foci of virus infected cells were randomly dispersed throughout the lung and were variably associated with inflammatory infiltrates (FIG. 26A-D). Some areas of parenchymal consolidation and inflammation contained little to no virus (FIG. 26A, arrows; FIG. 35). Virus infected cells frequently co-stained with pan-cytokeratin (FIG. 26E-H), suggesting that they were alveolar epithelial cells (pneumocytes). Uninfected Iba-1+CD68+CD206+ activated macrophages were also frequently detected adjacent to virally infected epithelial cells (FIG. 26E, I-K). These data demonstrate that 2019-nCoV induced multifocal areas of acute inflammation and viral pneumonia involving infected pneumocytes, ciliated bronchial epithelial cells, and likely other cell types.

Protective Efficacy Against Re-Challenge with 2019-nCoV in Rhesus Macaques

Figure 27A:
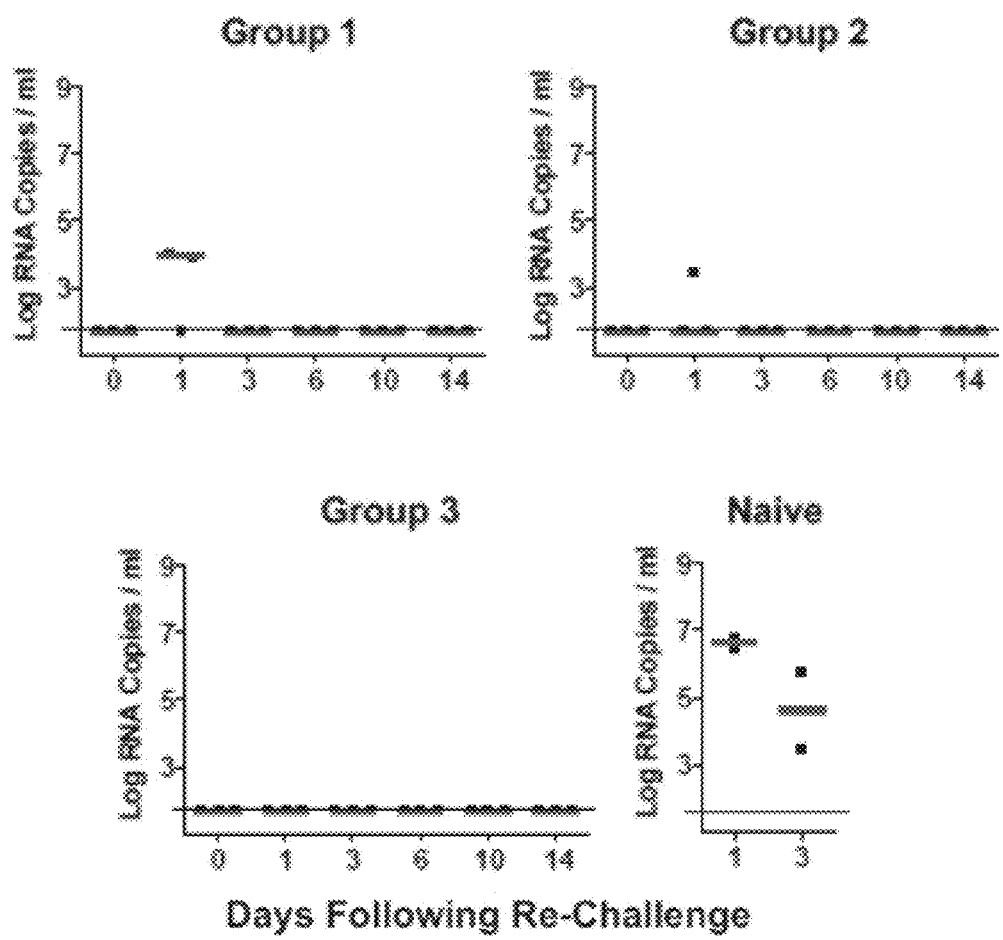
FIGS. 27A-27F are graphs showing viral loads following 2019-nCoV re-challenge in rhesus macaques. On day 35 following initial infection (see FIGS. 23A-23C and 24A-24F), rhesus macaques were re-challenged with 2019-nCoV by the intranasal and intratracheal route with $1.1 \times 10^6$ PFU (Group 1; N=3), $1.1 \times 10^5$ PFU (Group 2; N=3), or $1.1 \times 10^4$ PFU (Group 3; N=3). Three naïve animals were included as a positive control in the re-challenge experiment.
Figure 27B:
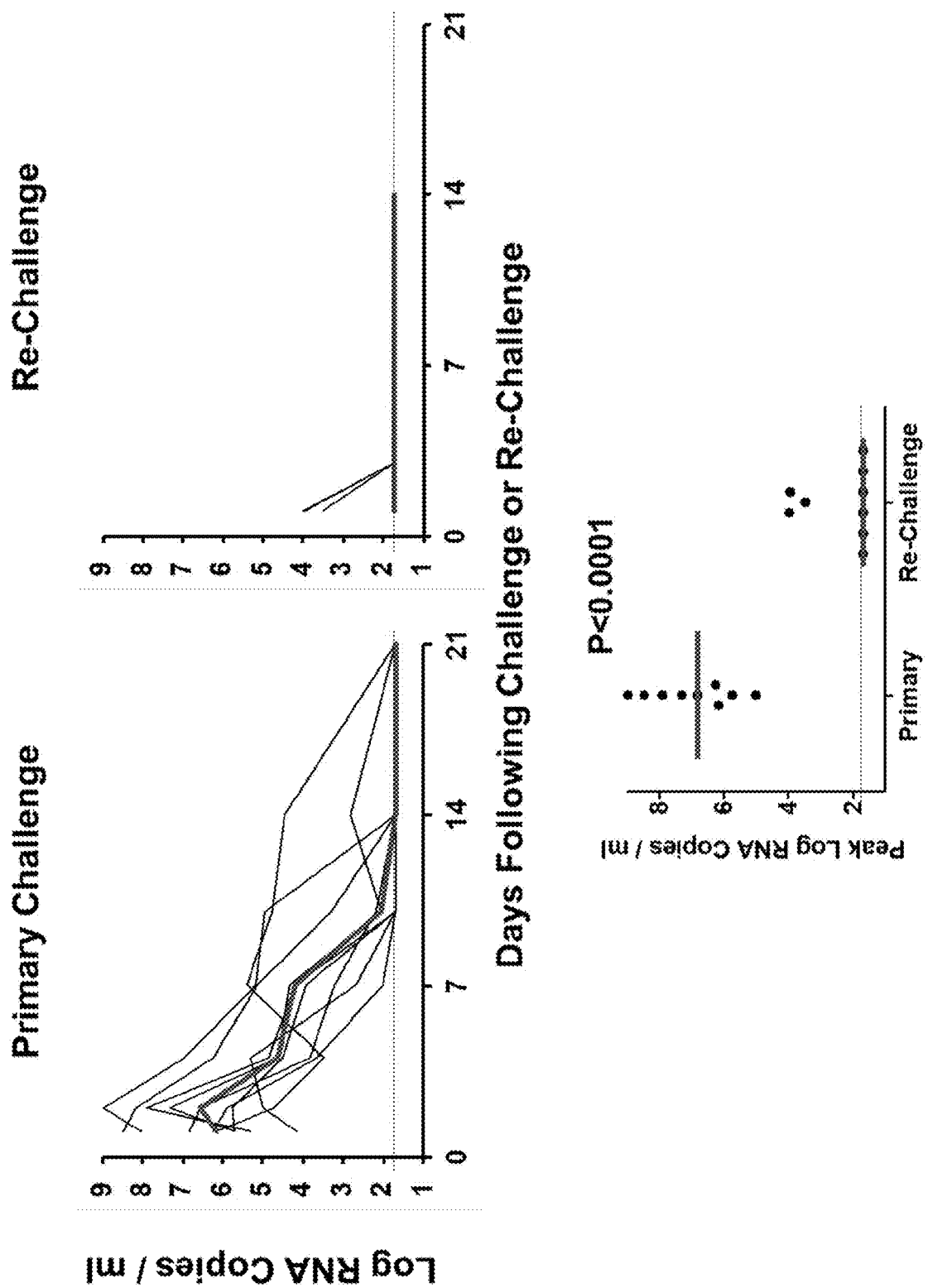
Figure 27C:
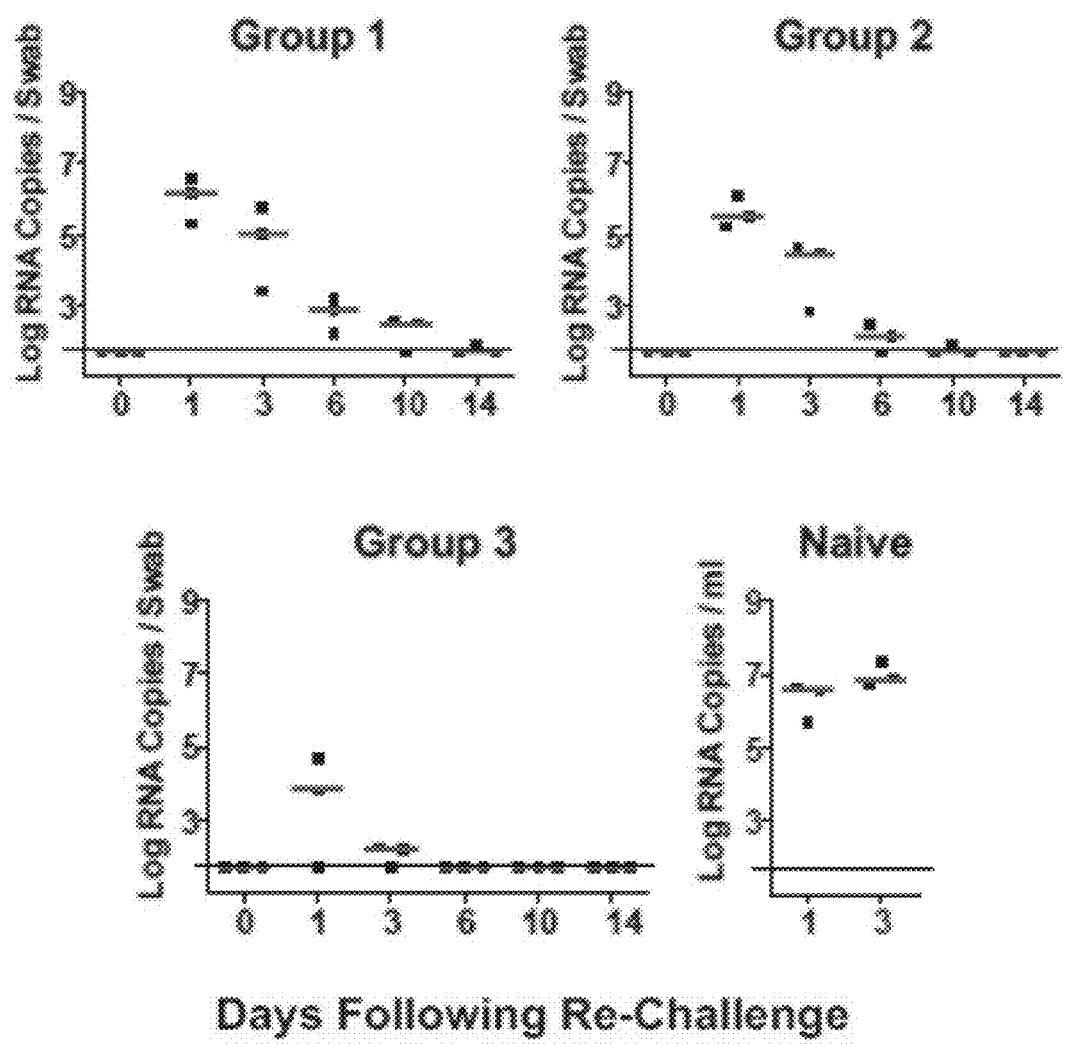
Figure 27D:
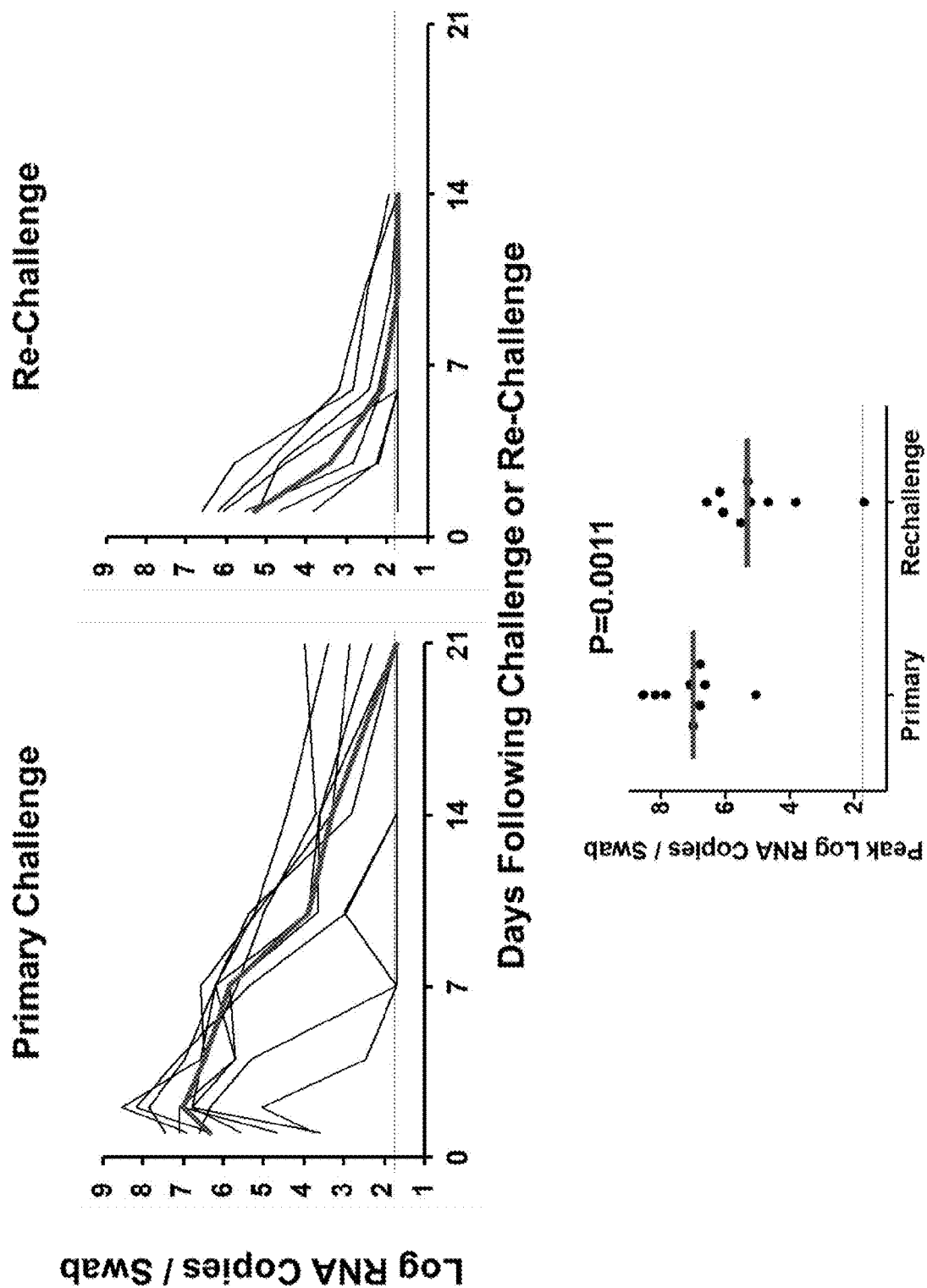

On day 35 following initial viral infection (FIGS. 23-24), all 9 rhesus macaques were rechallenged with the same doses of 2019-nCoV that were utilized for the primary infection, namely $1.1 \times 10^6$ PFU (Group 1; N=3), $1.1 \times 10^5$ PFU (Group 2; N=3), or $1.1 \times 10^4$ PFU (Group 3; N=3). 3 naïve animals were included as positive controls in the re-challenge experiment. Very limited viral RNA was observed in BAL on day 1 following re-challenge in two Group 1 animals and in one Group 2 animal, with no viral RNA detected at subsequent timepoints (FIG. 27A). In contrast, high levels of viral RNA were observed in the concurrently challenged naïve animals (FIG. 27A), as expected. Median peak viral loads in BAL were >5.1 $\log_{10}$ lower following re-challenge as compared with the primary challenge (P<0.0001, two-sided Mann-Whitney test; FIG. 27B). Viral RNA following re-challenge was higher in NS compared with BAL, but exhibited dose dependence and rapid decline (FIG. 27C), and median peak viral loads in NS were still >1.7 $\log_{10}$ lower following re-challenge as compared with the primary challenge (P=0.0011, two-sided Mann-Whitney test; FIG. 27D).

Figure 27E:
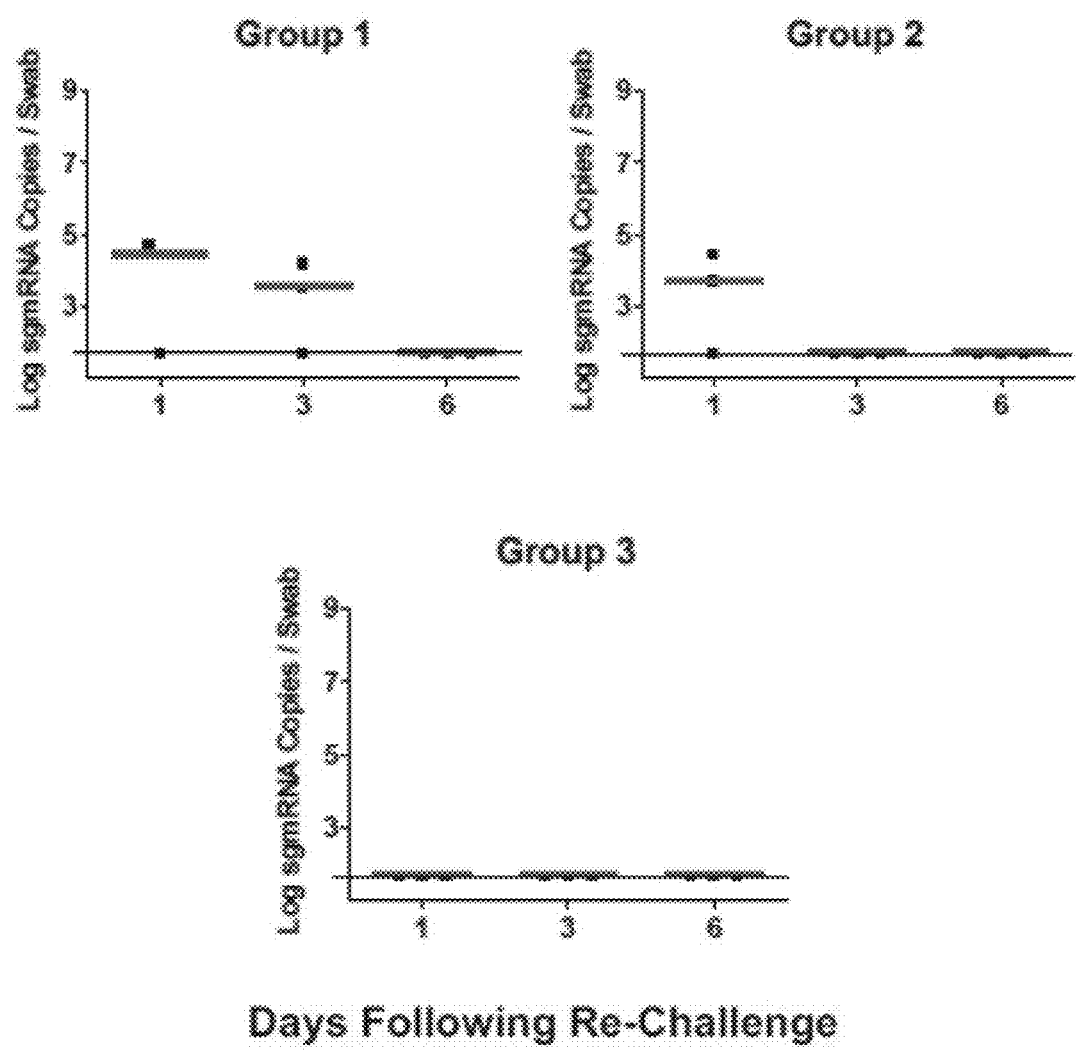
Figure 27F:
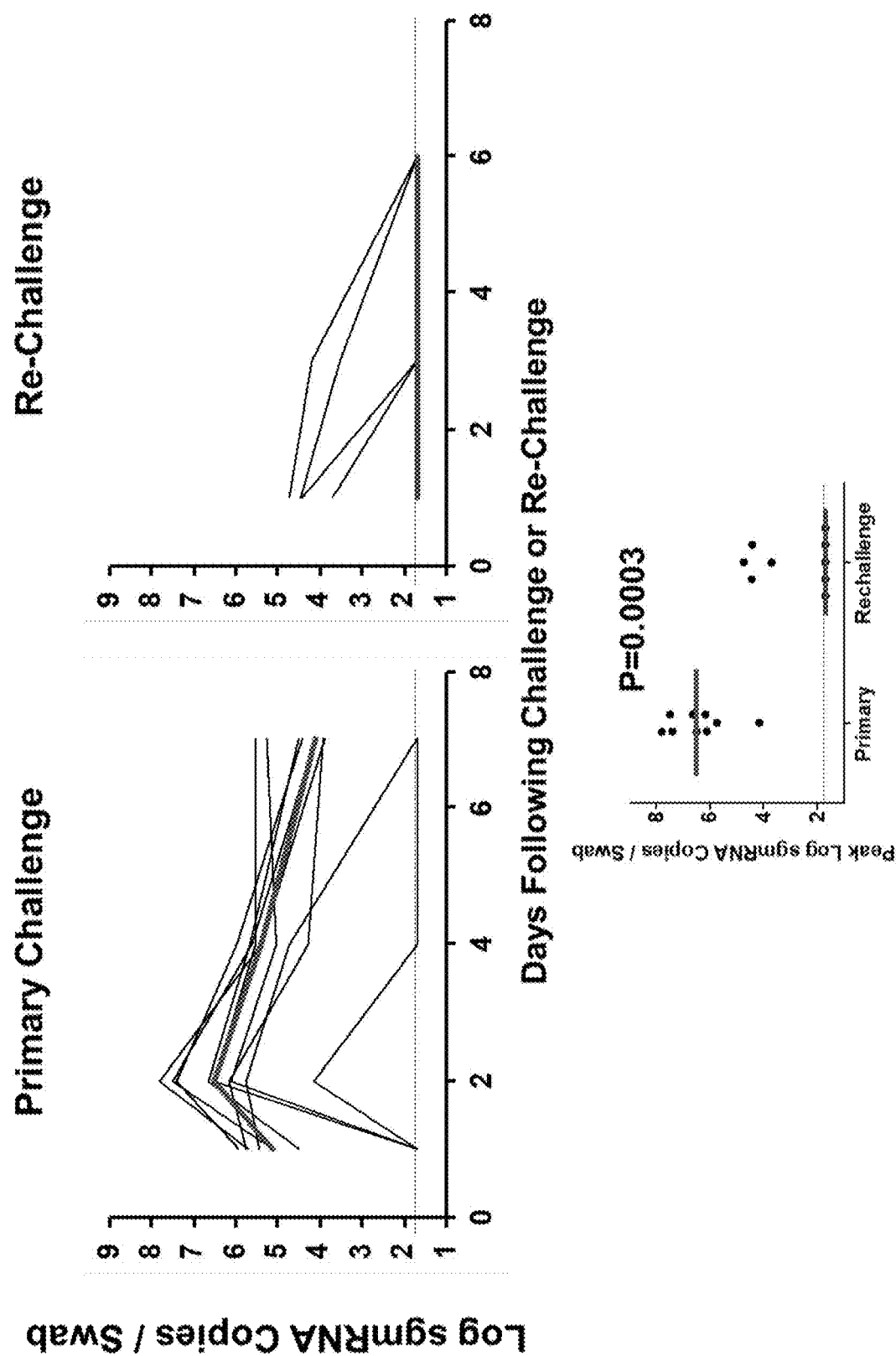
Figure 36:
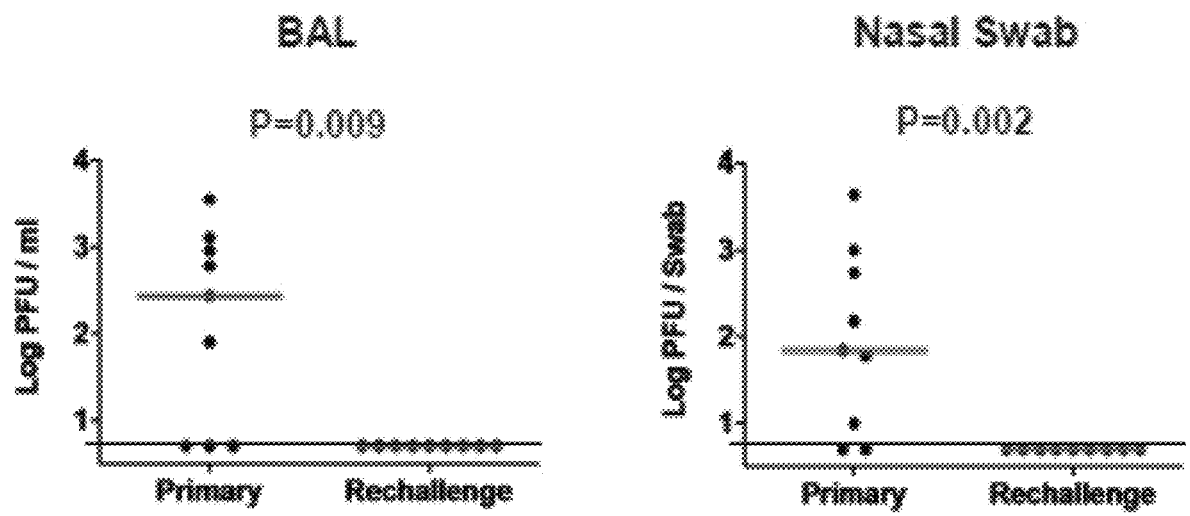
Figure 37:
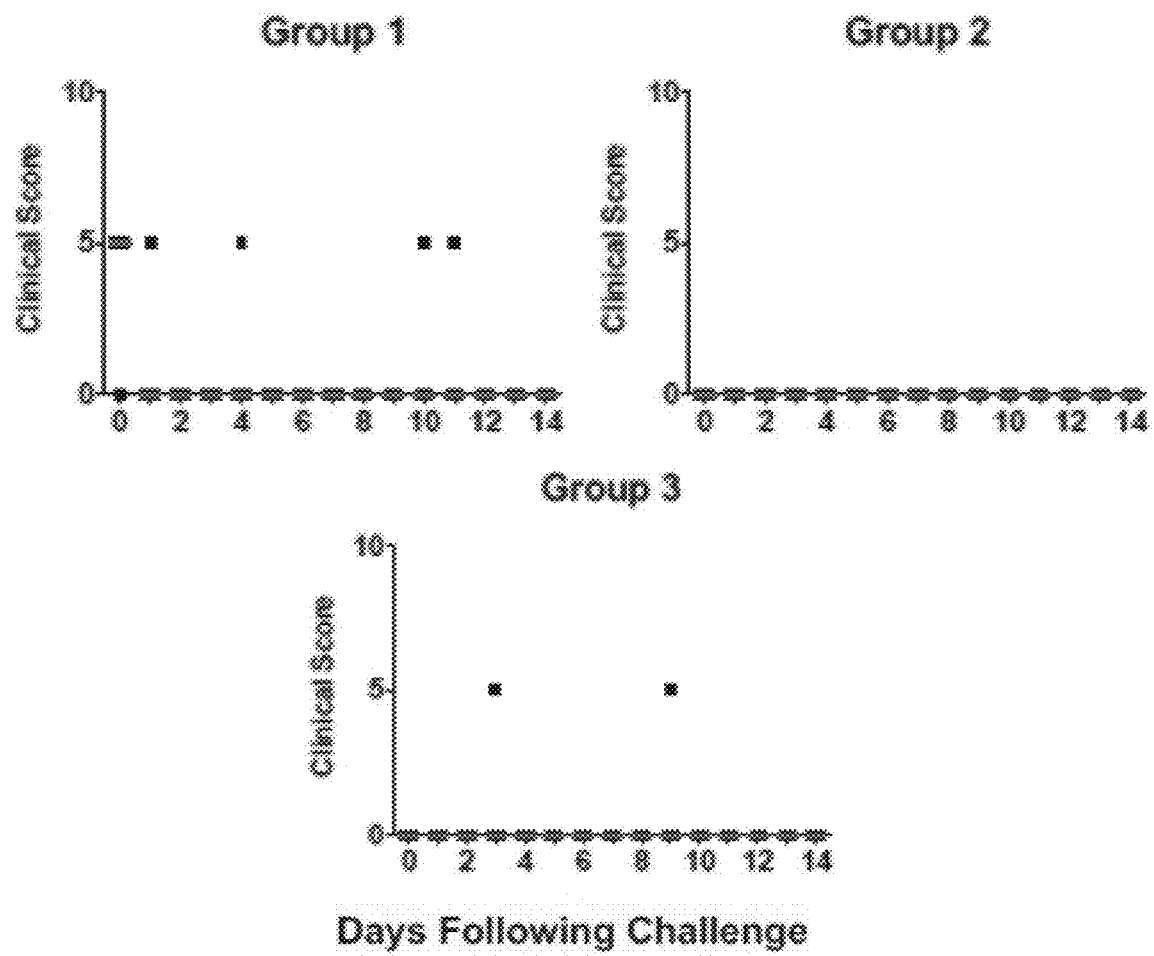
Figure 38A:
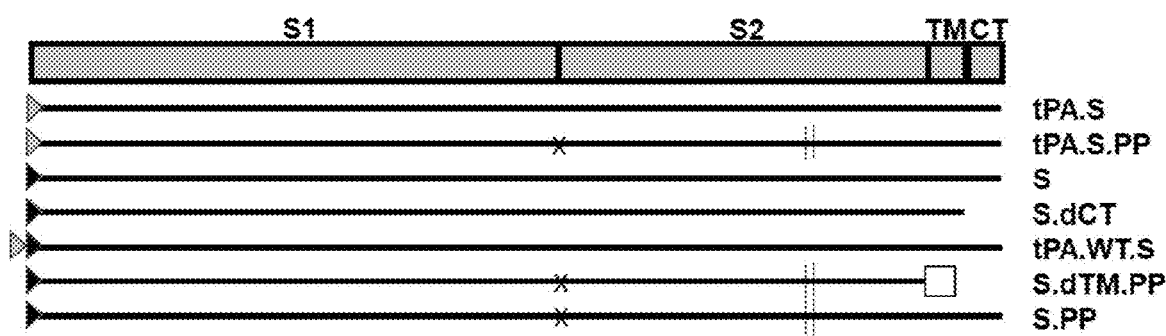
FIG. 38B is a western blot showing the recognition of SARS-CoV-2 S variants by polyclonal anti-SARS antibody. Western blot analyses for expression from Ad26 vectors encoding tPA.S (lane 1), tPA.S.PP (lane 2), S (lane 3), S.dCT (SS-SdCT) (lane 4), tPA.WT.S (lane 5), S.dTM.PP (SS-S.Ecto-dF-PP-foldon) (lane 6), and S.PP (SS-Spike-dF-PP) (lane 7) in cell lysates using an anti-SARS polyclonal antibody.
Figure 38B:
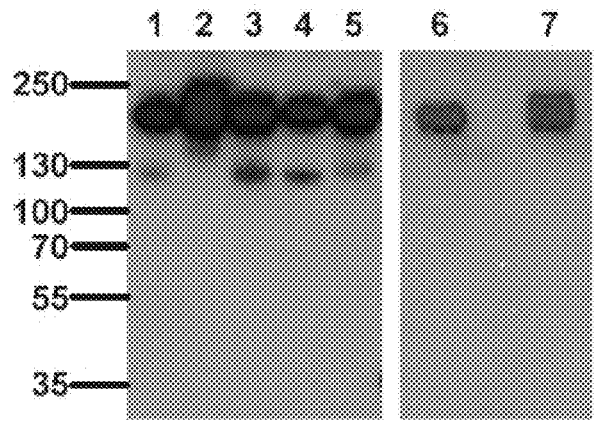
Figure 39A:
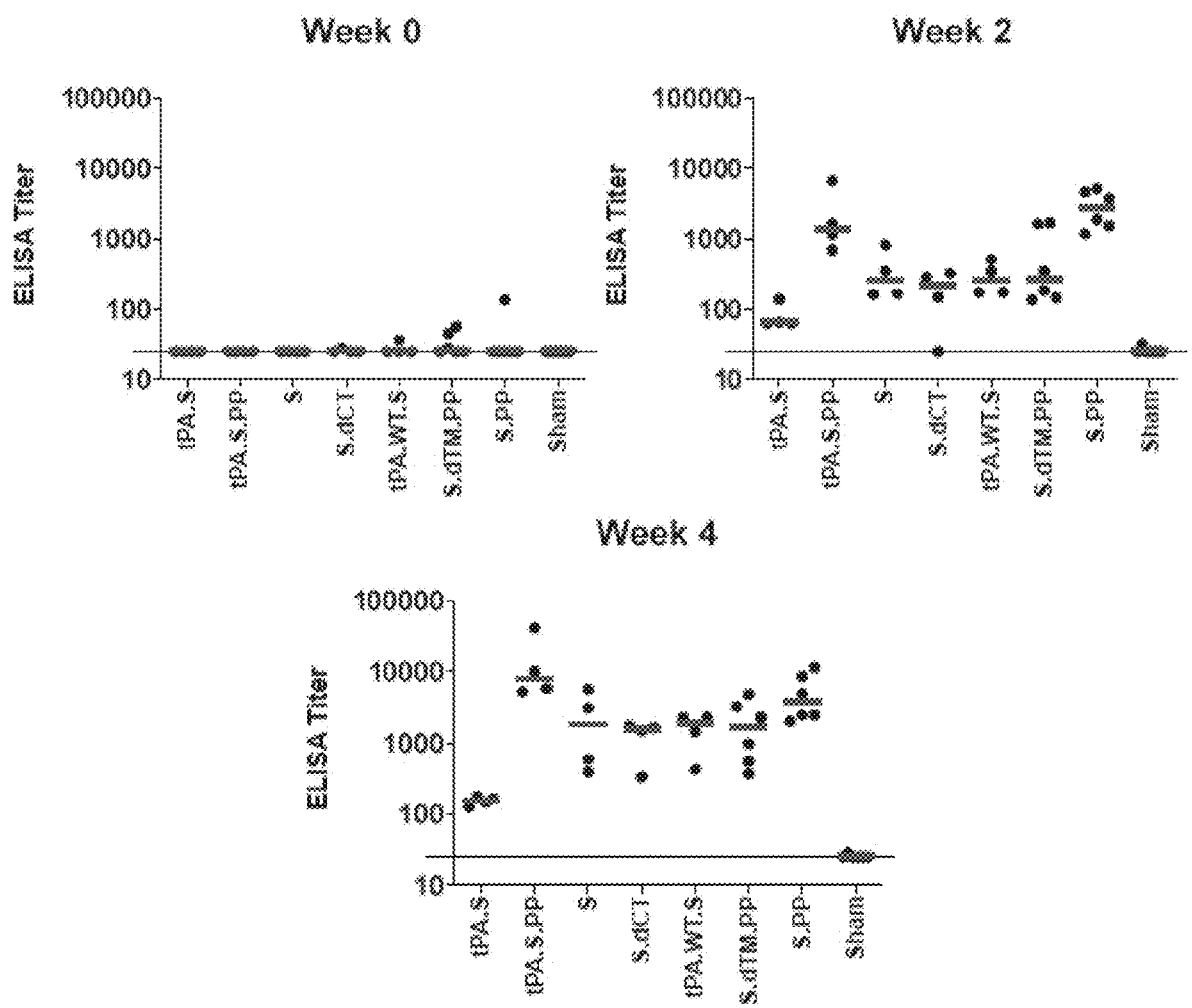
FIGS. 39A-39D are graphs showing humoral immune responses in vaccinated rhesus macaques. Humoral immune responses were assessed at weeks 0, 2, and 4 by (FIG. 39A) RBD-specific binding antibody ELISA, (FIG. 39B) pseudovirus neutralization assays, and (FIG. 39C) live virus neutralization assays. Red bars reflect median responses. Dotted lines reflect assay limit of quantitation.
Figure 39B:
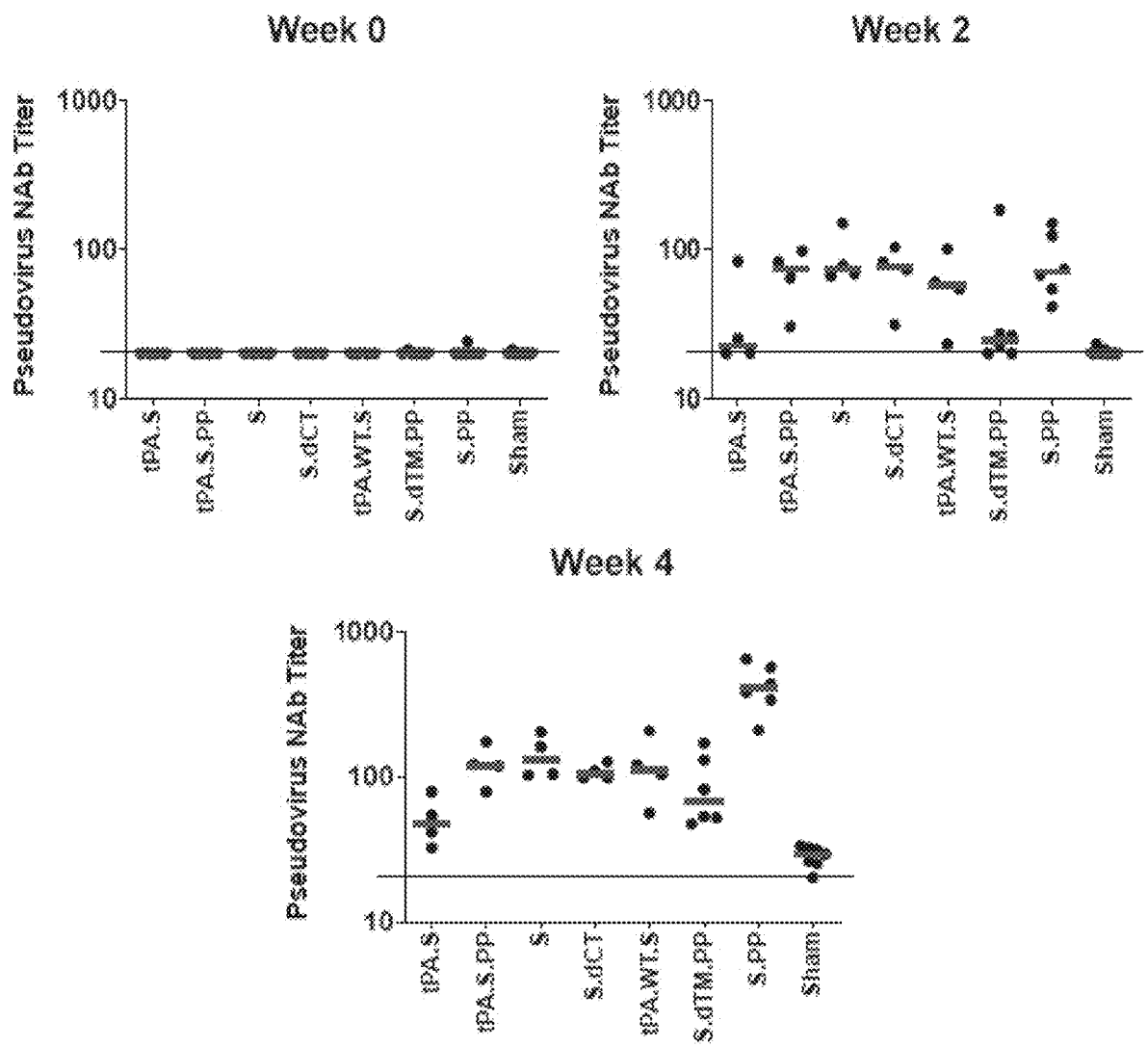
Figure 39C:
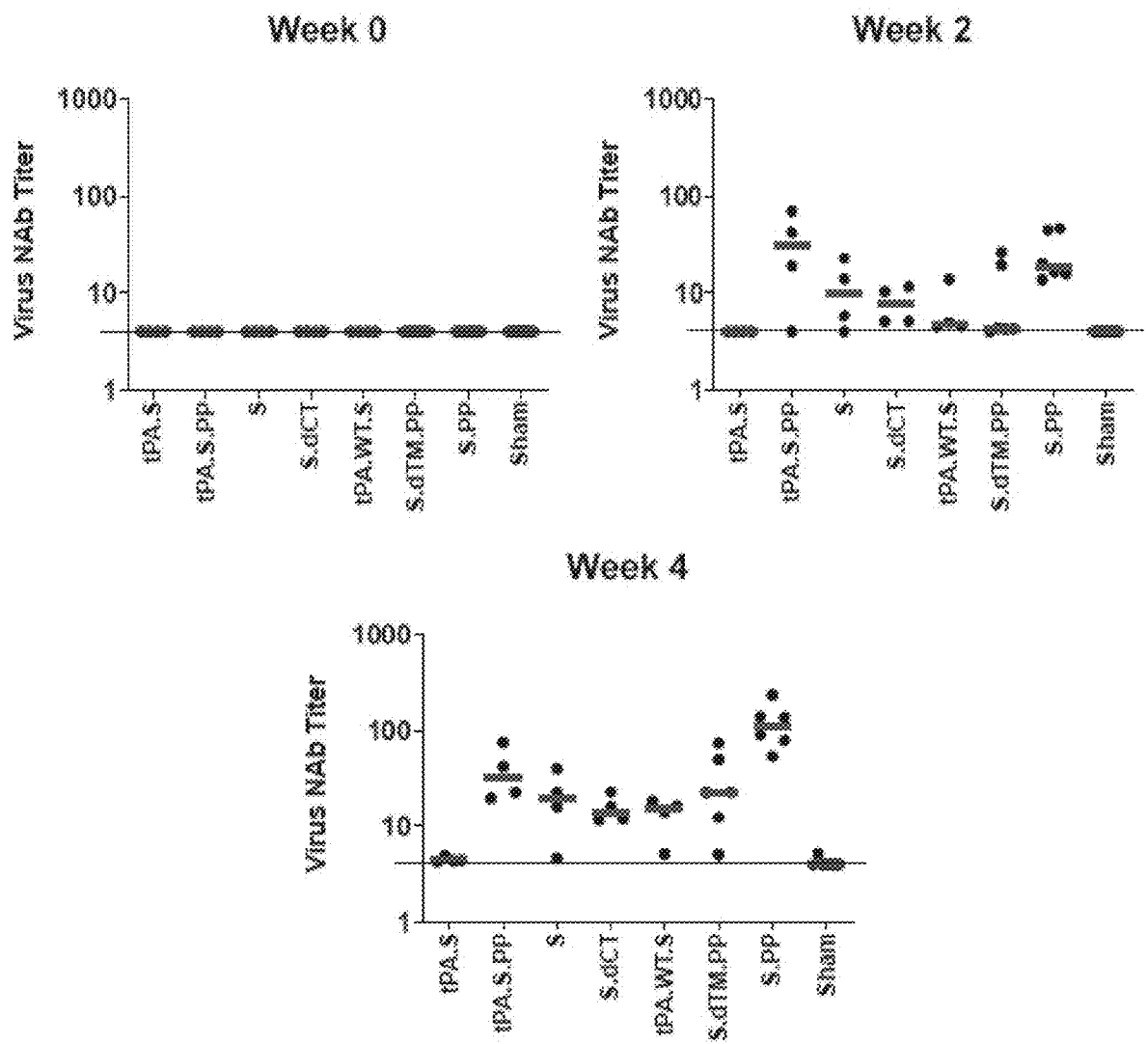
Figure 39D:
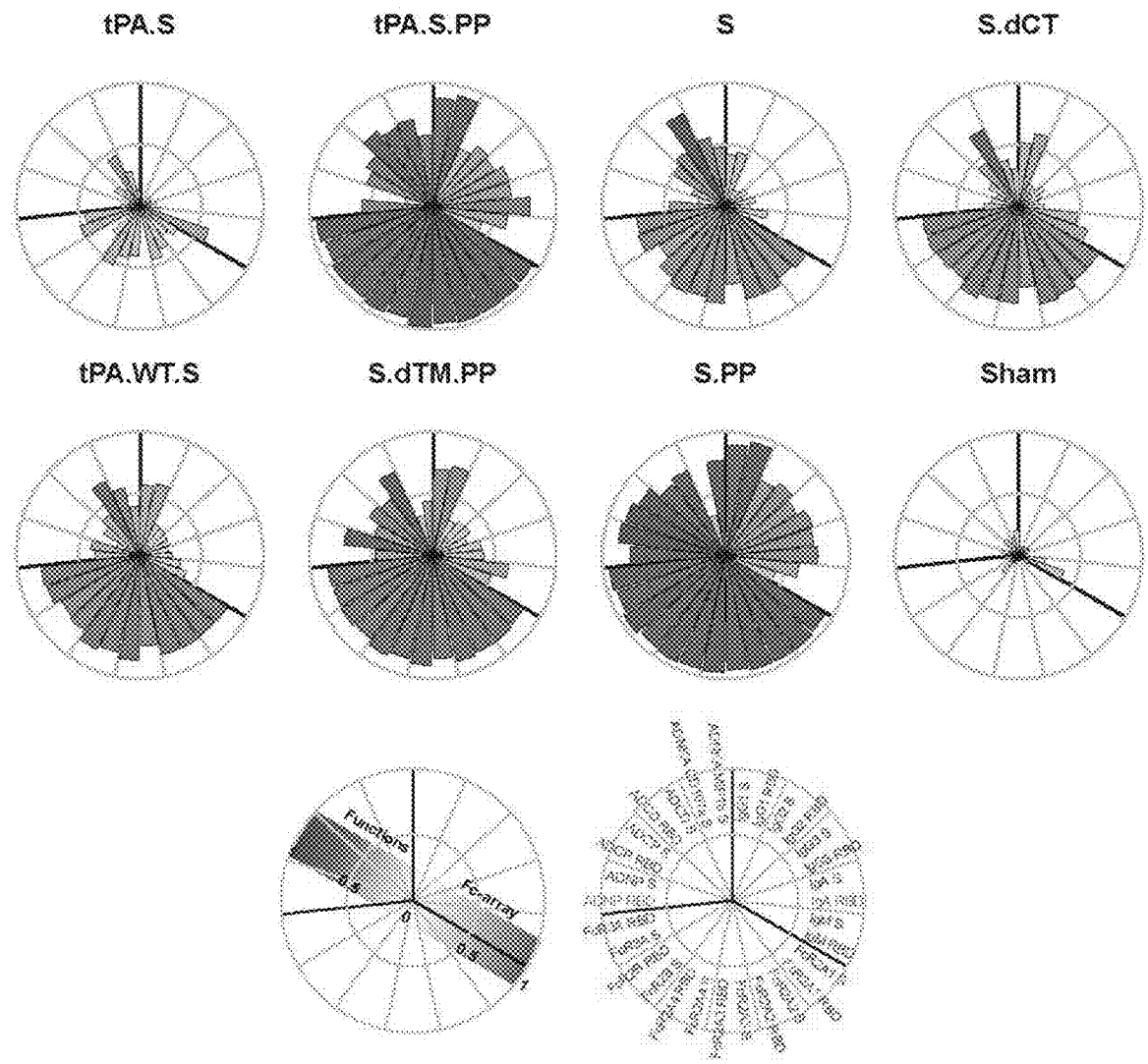
Figure 40A:
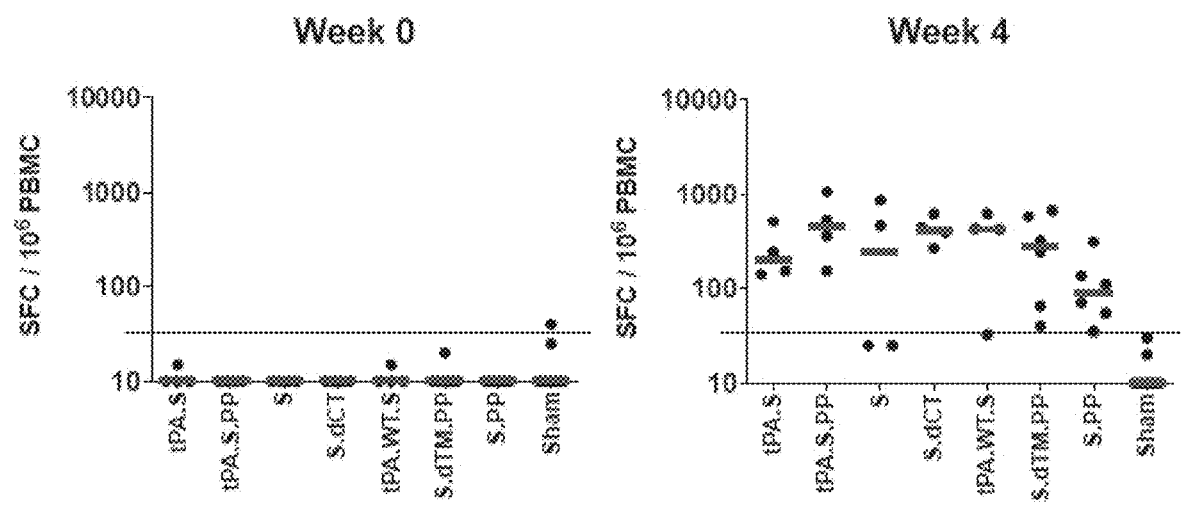
FIGS. 40A-40B are graphs showing cellular immune responses in vaccinated rhesus macaques. Cellular immune responses were assessed at week 4 following immunization by (FIG. 40A) IFN-γ ELISPOT assays and (FIG. 40B) IFN-γ+CD4+ and IFN-γ+CD8+ T cell intracellular cytokine staining assays in response to pooled S peptides. Red bars reflect median responses. Dotted lines reflect assay limit of quantitation.
Figure 40B:
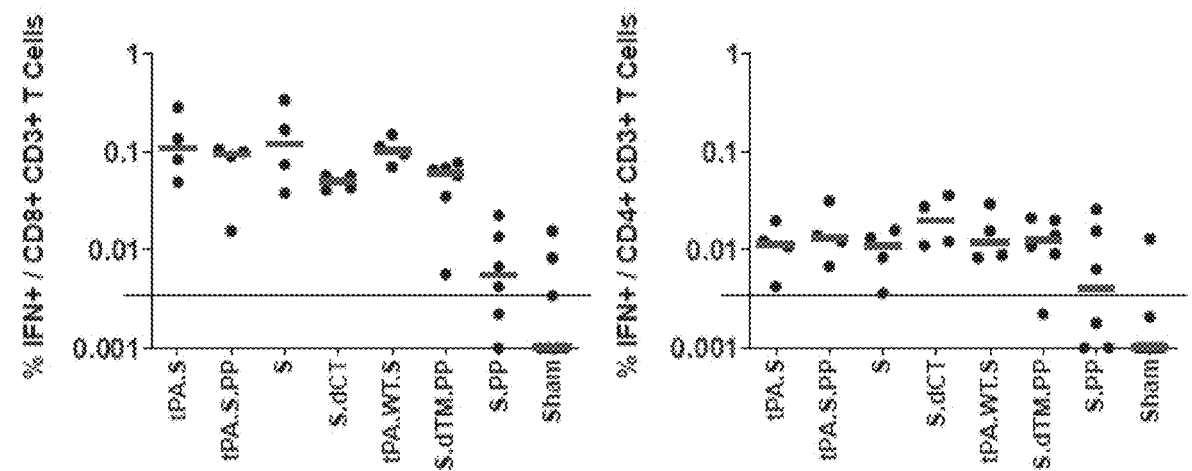

The majority of virus detected in NS following re-challenge was speculated to be input challenge virus, and therefore sgmRNA levels were assessed in NS following re-challenge. Low but detectable levels of sgmRNA were still observed in 4 of 9 animals in NS on day 1 following re-challenge, but sgmRNA levels declined quickly (FIG. 27E), and median peak sgmRNA levels in NS were >4.8 $\log_{10}$ lower following re-challenge as compared with the primary challenge (P=0.0003, two-sided Mann-Whitney test; FIG. 27F). Consistent with these data, plaque assays in BAL and NS samples following re-challenge showed no recoverable virus and were lower than following primary infection (P=0.009 and 0.002, respectively, two-sided Mann-Whitney tests; FIG. 36). Moreover, little or no clinical disease was observed in the animals following re-challenge (FIG. 37).

Figure 28:
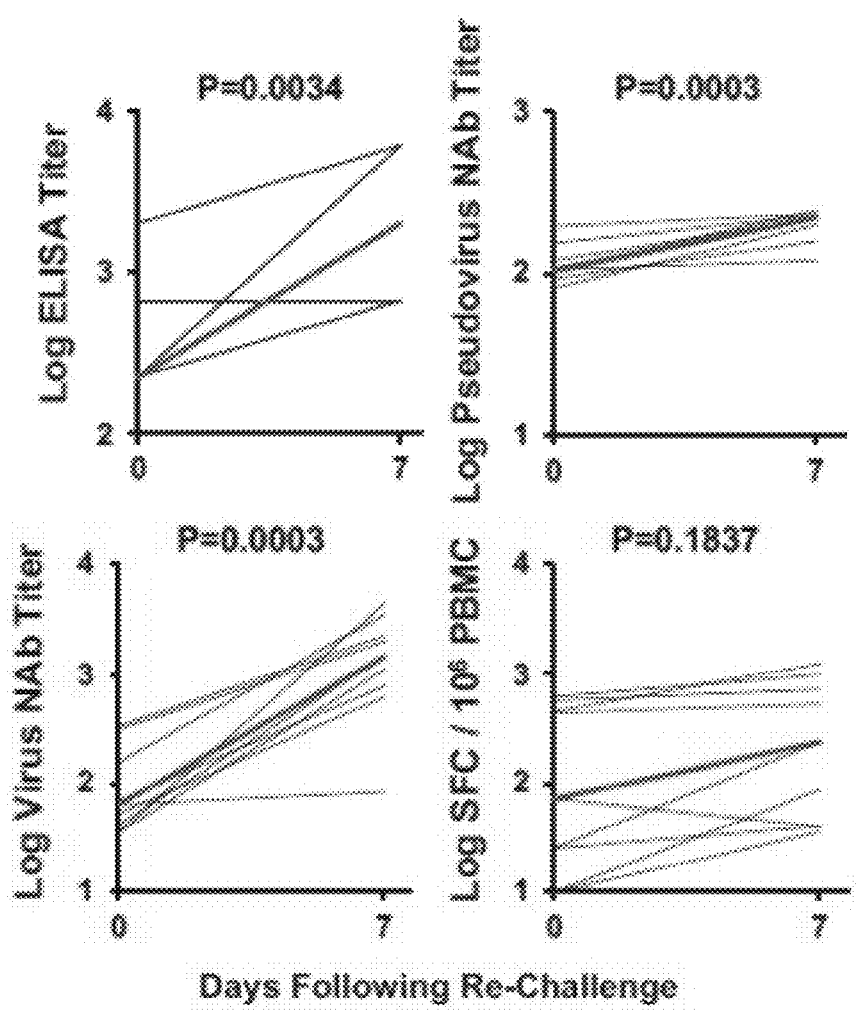
FIG. 28 is a series of graphs showing anamnestic immune responses following 2019-nCoV re-challenge in rhesus macaques. Virus-specific binding antibody ELISAs, pseudovirus neutralization assays, live virus neutralization assays, and IFN-γ ELISPOT assays are depicted prior to and 7 days following 2019-nCoV re-challenge. Red lines reflect mean responses. P-values reflect two-sided Mann-Whitney tests.

Following 2019-nCoV re-challenge, animals exhibited rapid anamnestic immune responses, including increased virus-specific ELISA titers (P=0.0034, two-sided Mann-Whitney test), pseudovirus NAb titers (P=0.0003), and live virus NAb titers (P=0.0003) as well as a trend towards increased IFN-γ ELISPOT responses (P=0.1837) by day 7 after re-challenge (FIG. 28). All animals developed anamnestic antibody responses following re-challenge, regardless of the presence or absence of residual viral RNA or sgmRNA in BAL or NS, and thus the protective efficacy against re-challenge was speculated to be mediated by rapid immunologic control.

Discussion

Individuals who recover from certain viral infections typically develop virus-specific antibody responses that provide robust protective immunity against re-exposure, but some viruses do not generate protective natural immunity, such as HIV-1 (17). Human challenge studies for the common cold coronavirus 229E have suggested that there may be partial natural immunity (18). However, there is currently no data whether humans who have recovered from 2019-nCoV infection are protected from re-exposure (World Health Organization, Scientific Brief, Apr. 24, 2020). This is a critical issue with profound implications for vaccine development, public health strategies, antibody-based therapeutics, and epidemiologic modeling of herd immunity. In this study, 2019-nCoV infection in rhesus macaques was demonstrated to provide substantial protective efficacy against 2019-nCoV re-challenge.

A rhesus macaque model of 2019-nCoV infection was developed that recapitulates many aspects of human 2019-nCoV infection, including high levels of viral replication in the upper and lower respiratory tract (FIG. 23) and clear pathologic evidence of viral pneumonia (FIGS. 25, 26). Histopathology, immunohistochemistry, RNASCOPE®, and CyCIF imaging demonstrated multifocal clusters of virus infected cells in areas of acute inflammation, with evidence for virus infection of alveolar pneumocytes and ciliated bronchial epithelial cells. These data suggest the utility of rhesus macaques as a model for 2019-nCoV infection for testing vaccines and therapeutics and for studying immunopathogenesis, and the findings complement and extend recently published data in cynomolgus macaques (19). However, neither nonhuman primate model led to respiratory failure or mortality, and thus further research will be required to develop a nonhuman primate model of severe COVID-19 disease.

2019-nCoV infection in rhesus macaques led to robust humoral and cellular immune responses (FIG. 2) and provided robust protection against re-challenge (FIG. 27). Residual low levels of subgenomic mRNA in nasal swabs in a subset of animals (FIG. 27) and anamnestic immune responses in all animals (FIG. 28) following 2019-nCoV re-challenge suggest that protection was mediated by rapid immunologic control and likely was not sterilizing.

2019-nCoV infection in rhesus monkeys resulted in the induction of neutralizing antibody titers of approximately 100 by both a pseudovirus neutralization assay and a live virus neutralization assay, but the relative importance of neutralizing antibodies, other functional antibodies, cellular immunity, and innate immunity to protective efficacy against 2019-nCoV remains to be determined. Moreover, additional research will be required to define the durability of natural immunity.

In summary, 2019-nCoV infection in rhesus macaques induced humoral and cellular immune responses and provided robust protective efficacy against 2019-nCoV re-challenge. These data raise the possibility that immunologic approaches to the prevention and treatment of 2019-nCoV infection may in fact be possible.

REFERENCES

1. F. Wu et al., A new coronavirus associated with human respiratory disease in China. *Nature* 579, 265-269 (2020).
2. P. Zhou et al., A pneumonia outbreak associated with a new coronavirus of probable bat origin. *Nature* 579, 270-273 (2020).
3. M. L. Holshue et al., First Case of 2019 Novel Coronavirus in the United States. *N Engl J Med* 382, 929-936 (2020).
4. Q. Li et at, Early Transmission Dynamics in Wuhan, China, of Novel Coronavirus-Infected Pneumonia. *N Engl J Med*, (2020).
5. N. Zhu et at, A Novel Coronavirus from Patients with Pneumonia in China, 2019. *N Engl J Med* 382, 727-733 (2020).
6. N. Chen et at, Epidemiological and clinical characteristics of 99 cases of 2019 novel coronavirus pneumonia in Wuhan, China: a descriptive study. *Lancet* 395, 507-513 (2020).
7. C. Huang et at, Clinical features of patients infected with 2019 novel coronavirus in Wuhan, China. *Lancet* 395, 497-506 (2020).
8. J. F. Chan et al., A familial cluster of pneumonia associated with the 2019 novel coronavirus indicating person-to-person transmission: a study of a family cluster. *Lancet* 395, 514-523 (2020).
9. R. Wolfel et at, Virological assessment of hospitalized patients with COVID-2019. *Nature*, (2020).
10. Z. Y. Yang et al., A DNA vaccine induces SARS coronavirus neutralization and protective immunity in mice. *Nature* 428, 561-564 (2004).
11. T. Scobey et al., Reverse genetics with a full-length infectious cDNA of the Middle East respiratory syndrome coronavirus. *Proc Natl Acad Sci USA* 110, 16157-16162 (2013).
12. B. Yount et at, Reverse genetics with a full-length infectious cDNA of severe acute respiratory syndrome coronavirus. *Proc Natl Acad Sci USA* 100, 12995-13000 (2003).
13. A. W. Chung et at, Dissecting Polyclonal Vaccine-Induced Humoral Immunity against HIV Using Systems Serology. *Cell* 163, 988-998 (2015).
14. C. Deleage et at, Impact of early cART in the gut during acute HIV infection. *JCI insight* 1, (2016).
15. C. Deleage et al., Defining HIV and SIV Reservoirs in Lymphoid Tissues. *Pathog Immun* 1, 68-106 (2016).
16. J. R. Lin et al., Highly multiplexed immunofluorescence imaging of human tissues and tumors using t-CyCIF and conventional optical microscopes. *eLife* 7, (2018).
17. M. Altfeld et al., HIV-1 superinfection despite broad CD8+ T-cell responses containing replication of the primary virus. *Nature* 420, 434-439 (2002).
18. K. A. Callow, H. F. Parry, M. Sergeant, D. A. Tyrrell, The time course of the immune response to experimental coronavirus infection of man. *Epidemiol Infect* 105, 435-446 (1990).

19. B. Rockx et al., Comparative pathogenesis of COVID-19, MERS, and SARS in a nonhuman primate model. *Science*, (2020).

Example 10. Administration or Re-Administration of an Anti-Coronavirus Composition to a Human Subject A human subject may be identified as susceptible to a coronavirus infection based upon the absence of an anti-coronavirus antibody level (e.g., in the blood of the subject) or an anti-coronavirus antibody level that is below a protective level, as defined herein. The subject can be administered an anti-coronavirus composition (e.g., any of the compositions or immunogenic compositions described herein) either as the first administration (a prime) or as a re-administration (a boost), according to the methods described herein. After treatment, the human subject can be tested for the effectiveness of the treatment by measuring an anti-coronavirus antibody level in the human subject (e.g., in the blood of the subject). If the level is below a protective level, as defined herein, the human subject may be given a subsequent boost of an anti-coronavirus composition or may be treated with a different anti-coronavirus composition from one previously administered.

The anti-coronavirus antibody level may be measured shortly after treatment (e.g., between 1 day post-administration and 8-weeks post-administration) in order to determine if additional doses (e.g., a boost) is needed to achieve a protective level of anti-coronavirus antibodies. The anti-coronavirus antibody level in the subject may also be monitored over a longer timeframe (e.g., between 2 month post-administration and 15 years post-administration) and an anti-coronavirus composition may be re-administered if the anti-coronavirus antibody level falls below a protective level, as defined herein.

Example 11. A Single-Dose Vaccine Protects Against 2019-nCoV in Rhesus Macaques

A safe and effective 2019-nCoV vaccine may be required to end the COVID-19 pandemic[1-8]. For global deployment and pandemic control, a vaccine that requires only a single immunization would be optimal. The immunogenicity and protective efficacy of a single dose of adenovirus serotype 26 (Ad26) vector-based vaccines expressing the 2019-nCoV spike (S) protein in nonhuman primates is shown herein. 52 rhesus macaques were immunized with Ad26 vectors expressing one of a panel of S variants or sham control and were challenged with 2019-nCoV by the intranasal and intratracheal routes[8,10]. The optimal Ad26 vaccine induced robust neutralizing antibody responses and provided complete or near-complete protection in bronchoalveolar lavage and nasal swabs following 2019-nCoV challenge. Vaccine-elicited neutralizing antibody titers correlated with protective efficacy, suggesting an immune correlate of protection. These data demonstrate robust single-shot vaccine protection against 2019-nCoV in nonhuman primates, which is an art-accepted animal model of disease treatment in humans. An optimal Ad26 vector-based vaccine for 2019-nCoV, termed Ad26.COV2.S, is planned for imminent clinical trials.

The rapid expansion of the COVID-19 pandemic has made the development of a 2019-nCoV vaccine a global health priority. Adenovirus serotype 26 (Ad26) vectors[11] have been shown to induce robust humoral and cellular immune responses to multiple pathogens in both nonhuman primates and humans. A series of Ad26 vectors expressing different variants of the 2019-nCoV spike (S) protein were developed and their immunogenicity and protective efficacy against 2019-nCoV challenge in rhesus macaques were evaluated.

Materials and Methods

Animals and study design. 52 outbred Indian-origin adult male and female rhesus macaques (*Macaca mulatta*), 6-12 years old, were randomly allocated to groups. All animals were housed at Bioqual, Inc. (Rockville, Md.). Animals received Ad26 vectors expressing tPA.S (N=4), tPA.S.PP (N=4), S (N=4), S.dCT (SS-SdCT) (N=4), tPA.WT.S (N=4), S.dTM.PP (SS-S.Ecto-dF-PP-foldon) (N=6), S.PP (SS-Spike-dF-PP) (N=6), and sham controls (N=20). Animals received a single immunization of $10^{11}$ viral particles (vp) Ad26 vectors by the intramuscular route without adjuvant at week 0. At week 6, all animals were challenged with $1.2 \times 10^8$ VP ($1.1 \times 10^4$ PFU) 2019-nCoV, which was derived from USA-WA1/2020 (NR-52281; BEI Resources)[9]. Virus was administered as 1 ml by the intranasal (IN) route (0.5 ml in each nare) and 1 ml by the intratracheal (IT) route. All immunologic and virologic assays were performed blinded. All animal studies were conducted in compliance with all relevant local, state, and federal regulations and were approved by the Bioqual Institutional Animal Care and Use Committee (IACUC).

Ad26 Vectors. Ad26 vectors were constructed with seven variants of the 2019-nCoV spike (S) protein sequence (Wuhan/WIV04/2019; Genbank MN996528.1). Sequences were codon optimized and synthesized. Replication-incompetent, E1/E3-deleted Ad26-vectors[11] were produced in PER.C6.TetR cells using a plasmid containing the full Ad26 vector genome and a transgene expression cassette. Vectors were sequenced and tested for expression prior to use.

Western Blot. T-25 flasks seeded with 293T cells at 70-80% confluency were transiently transfected with 2019-nCoV Ad26 vectors and cell lysates were harvested 48 h post-transfection and separately mixed with reducing sample buffer (Pierce), heated for 5 min at 95° C. and run on a precast 4-15% SDS-PAGE gel (Bio-Rad). Protein was transferred to a polyvinylidene difluoride (PVDF) membrane using an iBlot dry blotting system (Invitrogen), and membrane blocking performed overnight at 4° C. in Dulbecco's phosphate-buffered saline T (D-PBST) containing 0.2% Tween 20 (Sigma) (V/V) and 5% (W/V) non-fat milk powder. Following overnight blocking, the PVDF membrane was incubated for 1 h in 3% milk DPBS-T containing a 1:10,000 dilution of polyclonal guinea pig anti-SARS antibody (BEI resources) for 1 h. After this incubation, the PVDF membrane was washed five times with 5% milk DPBS-T and subsequently incubated with 1:30,000 anti-guinea pig or anti-rabbit horseradish peroxidase (HRP)-conjugated secondary antibody (Jackson Immunoresearch) in 3% milk DPBS-T. Finally, the PVDF membrane was washed again five times with 5% milk DPBS-T, and developed using an Amersham ECL Plus Western blotting detection system (GE Healthcare).

Subgenomic mRNA assay. 2019-nCoV E gene subgenomic mRNA (sgmRNA) was assessed by RT-PCR using an approach similar to previously described[9,10,20]. Briefly, to generate a standard curve, the 2019-nCoV E gene sgmRNA was cloned into a pcDNA3.1 expression plasmid; this insert was transcribed using an AmpliCap-Max T7 High Yield Message Maker Kit (Cellscript) to obtain RNA for standards. Prior to RT-PCR, samples collected from challenged animals or standards were reverse-transcribed using Superscript III VILO (Invitrogen) according to the manufacturer's instructions. A Taqman custom gene expression assay (ThermoFisher Scientific) was designed using the sequences targeting the E gene sgmRNA[20]. Reactions were carried out on a QuantStudio 6 and 7 Flex Real-Time PCR System (Applied Biosystems) according to the manufacturer's specifications. Standard curves were used to calculate sgmRNA in copies per ml or per swab; the quantitative assay sensitivity was 50 copies per ml or per swab.

PFU assay. For plaque assays, confluent monolayers of Vero E6 cells were prepared in 6-well plates. Indicated samples collected from challenged animals were serially diluted, added to wells, and incubated at 37° C. for 1 h. After incubation, 1.5 mL of 0.5% methylcellulose media was added to each well and the plates were incubated at 37° C. with 5% $CO_2$ for 2 days. Plates were fixed by adding 400 μL ice cold methanol per well and incubating at −20° C. for 30 min. After fixation, the methanol was discarded, and cell monolayers were stained with 600 μL per well of 0.23% crystal violet for 30 min. After staining, the crystal violet was discarded, and the plates were washed once with 600 μL water to visualize and count plaques.

ELISA. RBD-specific binding antibodies were assessed by ELISA essentially as described[9,10]. Briefly, 96-well plates were coated with 1 μg/mL 2019-nCoV RBD protein (Aaron Schmidt, MassCPR) in 1×DPBS and incubated at 4° C. overnight. After incubation, plates were washed once with wash buffer (0.05% Tween20 in 1×DPBS) and blocked with 350 μL Casein block/well for 2-3 h at room temperature. After incubation, block solution was discarded and plates were blotted dry. Serial dilutions of heat-inactivated serum diluted in Casein block were added to wells and plates were incubated for 1 h at room temperature, prior to three further washes and a 1 h incubation with a 1:1000 dilution of anti-macaque IgG HRP (NIH NHP Reagent Program) at room temperature in the dark. Plates were then washed three times, and 100 μL of SERACARE® KPL TMB SureBlue Start solution was added to each well; plate development was halted by the addition of 100 μL SERACARE® KPL TMB Stop solution per well. The absorbance at 450 nm was recorded using a VERSAMAX™ or OMEGA® microplate reader. ELISA endpoint titers were defined as the highest reciprocal serum dilution that yielded an absorbance >0.2. Log 10 endpoint titers are reported.

Pseudovirus neutralization assay. The 2019-nCoV pseudoviruses expressing a luciferase reporter gene were generated in an approach similar to as described previously[9,10,16]. Briefly, the packaging construct psPAX2 (AIDS Resource and Reagent Program), luciferase reporter plasmid pLenti-CMV Puro-Luc (Addgene), and spike protein expressing pcDNA3.1-SARS CoV-2 SΔCT were co-transfected into HEK293T cells with calcium phosphate. The supernatants containing the pseudotype viruses were collected 48 h post-transfection; pseudotype viruses were purified by filtration with 0.45 μm filter. To determine the neutralization activity of the antisera from vaccinated animals, HEK293T-hACE2 cells were seeded in 96-well tissue culture plates at a density of $1.75×10^4$ cells/well overnight. Two-fold serial dilutions of heat inactivated serum samples were prepared and mixed with 50 μL of pseudovirus. The mixture was incubated at 37° C. for 1 h before adding to HEK293T-hACE2 cells. After 48 h, cells were lysed in STEADY-GLO® Luciferase Assay (Promega) according to the manufacturer's instructions. 2019-nCoV neutralization titers were defined as the sample dilution at which a 50% reduction in RLU was observed relative to the average of the virus control wells.

Live virus neutralization assay. A full-length 2019-nCoV virus based on the Seattle Wash. isolate was designed to express luciferase and GFP and was recovered via reverse genetics as described previously[17,18]. The virus was titered in Vero E6 USAMRID cells to obtain a relative light units (RLU) signal of at least 10× the cell only control background. Vero E6 USAMRIID cells were plated at 20,000 cells per well the day prior in clear bottom black walled 96-well plates. Neutralizing antibody serum samples were tested at a starting dilution of 1:4 and were serially diluted 4-fold up to eight dilutions. Antibody-virus complexes were incubated at 37° C. with 5% $CO_2$ for 1 h. Following incubation, growth media was removed and virus-antibody dilution complexes were added to the cells in duplicate. Virus-only controls and cell-only controls were included in each neutralization assay plate. Following infection, plates were incubated at 37° C. with 5% $CO_2$ for 48 h. Cells were then lysed and luciferase activity was measured via Nano-Glo Luciferase Assay System (Promega) according to the manufacturer specifications. 2019-nCoV neutralization titers were defined as the sample dilution at which a 50% reduction in RLU was observed relative to the average of the virus control wells.

Systems Serology.

Luminex

A customized multiplexed approach to quantify relative antigen-specific antibody titers was used, as previously described[29]. Therefore, microspheres (Luminex) with a unique fluorescence were coupled with 2019-nCoV antigens including spike protein (S) and Receptor Binding Domain (RBD) via covalent N-hydroxysuccinimide (NHS)-ester linkages via EDC (Thermo Scientific) and Sulfo-NHS (Thermo Scientific). Per well in a 384-well plate (Greiner), $1.2×10^3$ beads per region/antigen were added and incubated with diluted serum sample (1:100 for all isotypes/subclasses except for IgG1, which was diluted 1:250 as well as Fc-receptor binding) for 16h shaking at 900 rmp at 4° C. Following formation of immune complexes, microspheres were washed three times in 0.1% BSA and 0.05% Tween-20 (Luminex assay buffer) with an automated plate washer (Tecan). Anti-rhesus IgG1, IgG2, IgG3, IgA (NIH NHP Reagent Program) and IgM (Life Diagnostic) detection antibodies were diluted in Luminex assay buffer to 0.65 ug/mL and incubated with beads for 1h at RT while shaking at 900 rpm. Following washing of stained immune complexes, a tertiary goat anti-mouse IgG-PE antibody (Southern Biotech) was added to each well at 0.5 ug/mL and incubated for 1 h at RT on a shaker. Similarly, for the Fc-receptor binding profiles, recombinant rhesus FcγR2A-1, FcγR2A-2, FcγR2A-3, FcγR2A-4, FcγR3A and human FcγR2B (Duke Protein Production facility) were biotinylated (Thermo Scientific) and conjugated to Streptavidin-PE for 10 min (Southern Biotech). The coated beads were then washed and read on a flow cytometer, iQue (Intellicyt) with a robot arm attached (PAA). Events were gated on each bead region, median fluorescence of PE for of bead positive events was reported. Samples were run in duplicate per each secondary detection agent.

Bead-Based ADNP, ADCP, ADCD

Antibody-dependent neutrophil phagocytosis (ADNP), antibody-dependent cellular phagocytosis (ADCP), and antibody-dependent complement deposition (ADCD) were performed as previously described[30-32]. Briefly, 2019-nCoV S and RBD were biotinylated (Thermo Fisher) and coupled to 1 μm yellow (ADCP, ADNP) and red (ADCD) fluorescent beads for 2h at 37° C. Excess antigen was removed by washing twice with 0.1% BSA in PBS. Following, $1.82×10^8$ antigen-coated beads were added to each well of a 96-well plate and incubated with diluted samples (ADCP and ADNP 1:100, ADCD 1:10) at 37° C. for 2h to facilitate immune complex formation. After the incubation, complexed beads were washed and for ADCP, $2.5 \times 10^4$ THP-1 cells (American Type Culture Collection) were added per well and incubated for 16h at 37° C. For ADNP, peripheral blood mononuclear cells (PBMCs) were isolated from healthy blood donors by lysis of red blood cells by addition of Ammonium-Chloride-Potassium (ACK) lysis (Thermo fisher) and $5 \times 10^4$ cells were added per well and incubated for 1h at 37° C. Subsequently, primary blood cells were stained with an anti-Cd66b Pac blue detection antibody (BioLegend). For ADCD, lyophilized guinea pig complement was reconstituted according to manufacturer's instructions (Cedarlane) with water and 4 μl per well were added in gelatin veronal buffer containing $Mg^{2+}$ and $Ca^{2+}$ ($GVB^{++}$, Boston BioProducts) to the immune complexes for 20 min at 37° C. After washing twice with 15 mM EDTA in PBS, immune complexes were stained with a fluorescein-conjugated goat IgG fraction to guinea pig complement C3 (MpBio). Following incubation with THP-s and staining of cells for ADNP and ADCD cell samples are fixed with 4% paraformaldehyde (PFA) and sample acquisition was performed via flow cytometry (Intellicyt, iQue Screener plus) utilizing a robot arm (PAA). All events were gated on single cells and bead positive events, for ADCP and ADNP, a phagocytosis score was calculated as the percent of bead positive cells x GMFI/1,000. For ADCD, the median of C3 positive events is reported. All samples were run in duplicate on separate days.

ADNKA

For analysis of NK-cell related responses, an ELISA-based assay was used. Therefore, 96-well ELISA plates (Thermo Fisher) were coated with 2019-nCoV S at 37° C. for 2h. Plates were then washed and blocked with 5% BSA in PBS overnight at 4° C. NK cells were isolated from buffy coats from healthy donors (MGH blood donor center) using the RosetteSep isolation kit (Stem Cell Technologies) and NK cells were rested overnight supplemented with IL-15 (Stemcell). Serum samples were diluted 1:50 and incubated at 37° C. for 2h on the ELISA plates. A staining cocktail of anti-CD107a-PE-Cy5 stain (BD), brefeldin A (Sigma), and GolgiStop (BD) was added to the NK cells and $5 \times 10^4$ NK cells per well were added and incubated for 5h at 37° C. NK cells were fixed and permeabilized using Perm A and B (Thermo Fisher) and surface markers were stained for with anti-CD16 APC-Cy7 (BD), anti-CD56 PE-Cy7 (BD) and anti-CD3 AlexaFluor 700 antibodies (BD). Intracellular staining included anti-IFNγ APC (BD) and anti-MIP-1β PE (BD). Acquisition occurred by flow cytometry iQue (Intellicyt), equipped with a robot arm (PAA). NK cells were defined as CD3−, CD16+ and CD56+. The ADNKA assay was performed in duplicate across two blood donors.

Analysis

All isotypes/subclasses, Fc-receptor binding and ADCD data were $\log_{10}$ transformed. For the radar plots, each antibody feature was normalized such that its minimal value is 0 and the maximal value is 1 across groups before using the median within a group. A principal component analysis (PCA) was constructed using the R package 'ropls' to compare multivariate profiles. Completely protected animals were defined as having no detectable sgmRNA copies/mL in BAL and NS. Completely protected vs. partially protected and non-protected animals were compared using two-sided Mann-Whitney tests. For the visualization in the heatmap, the differences in the means of completely and partially protected group of z-scored features were shown.

To indicate significances in the heatmap, a Benjamini-Hochberg correction was used to correct for multiple comparisons. To assess the ability of features and their combinations to predict protection, logistic regression models were trained for 100 repetitions in a 10-fold cross-validation framework and areas under the receiver operator characteristics (AUROC) curves were calculated. All potential combinations of two features were tested. For this, the R packages 'glm' and 'pROC' were used.

ELISPOT assay. ELISPOT plates were coated with mouse anti-human IFN-γ monoclonal antibody from BD Pharmingen at a concentration of 5 pg/well overnight at 4° C. Plates were washed with DPBS containing 0.25% Tween20, and blocked with R10 media (RPMI with 11% FBS and 1.1% penicillin-streptomycin) for 1 h at 37° C. The Spike 1 and Spike 2 peptide pools contain 15 amino acid peptides overlapping by 11 amino acids that span the protein sequence and reflect the N- and C-terminal halves of the protein, respectively. Spike 1 and Spike 2 peptide pools were prepared at a concentration of 2 pg/well, and 200,000 cells/well were added. The peptides and cells were incubated for 18-24 h at 37° C. All steps following this incubation were performed at room temperature. The plates were washed with coulter buffer and incubated for 2 h with Rabbit polyclonal anti-human IFN-γ Biotin from U-Cytech (1 μg/mL). The plates are washed a second time and incubated for 2 h with Streptavidin-alkaline phosphatase antibody from Southern Biotechnology (1 μg/mL). The final wash was followed by the addition of Nitor-blue Tetrazolium Chloride/5-bromo-4-chloro 3'indolyl phosphate p-toludine salt (NBT/BCIP chromagen) substrate solution for 7 min. The chromagen was discarded and the plates were washed with water and dried in a dim place for 24 h. Plates were scanned and counted on a Cellular Technologies Limited Immunospot Analyzer.

Intracellular cytokine staining assay. $10^6$ PBMCs/well were re-suspended in 100 μL of R10 media supplemented with CD49d monoclonal antibody (1 μg/mL). Each sample was assessed with mock (100 μL of R10 plus 0.5% DMSO; background control), peptide pools (2 μg/mL), or 10 μg/mL phorbol myristate acetate (PMA) and 1 μg/mL ionomycin (Sigma-Aldrich) (100 μL; positive control) and incubated at 37° C. for 1 h. After incubation, 0.25 μL of GolgiStop and 0.25 μL of GolgiPlug in 50 μL of R10 was added to each well and incubated at 37° C. for 8 h and then held at 4° C. overnight. The next day, the cells were washed twice with DPBS, stained with Near IR live/dead dye for 10 mins and then stained with predetermined titers of mAbs against CD279 (clone EH12.1, BB700), CD38 (clone OKT10, PE), CD28 (clone 28.2, PE CY5), CD4 (clone L200, BV510), CD45 (clone D058-1283, BUV615), CD95 (clone DX2, BUV737), CD8 (clone SK1, BUV805), for 30 min. Cells were then washed twice with 2% FBS/DPBS buffer and incubated for 15 min with 200 μL of BD CytoFix/CytoPerm Fixation/Permeabilization solution. Cells were washed twice with 1× Perm Wash buffer (BD Perm/Wash™ Buffer 10× in the CytoFix/CytoPerm Fixation/Permeabilization kit diluted with MilliQ water and passed through 0.22 μm filter) and stained with intracellularly with mAbs against Ki67 (clone B56, FITC), CD69 (clone TP1.55.3, ECD), IL10 (clone JES3-9D7, PE CY7), IL13 (clone JES10-5A2, BV421), TNF-α (clone Mab11, BV650), IL4 (clone MP4-25D2, BV711), IFN-γ (clone B27; BUV395), IL2 (clone MQ1-17H12, APC), CD3 (clone SP34.2, Alexa 700), for 30 min. Cells were washed twice with 1× Perm Wash buffer and fixed with 250 μL of freshly prepared 1.5% formaldehyde.

Fixed cells were transferred to 96-well round bottom plate and analyzed by BD FACSymphony™ system.

Statistical analyses. Analysis of virologic and immunologic data was performed using GraphPad Prism 8.4.2 (GraphPad Software). Comparison of data between groups was performed using two-sided Mann-Whitney tests. Correlations were assessed by two-sided Spearman rank-correlation tests. P-values of less than 0.05 were considered significant.

Results

Generation and Immunogenicity of Ad26 Vaccine Candidates

Figure 43A:
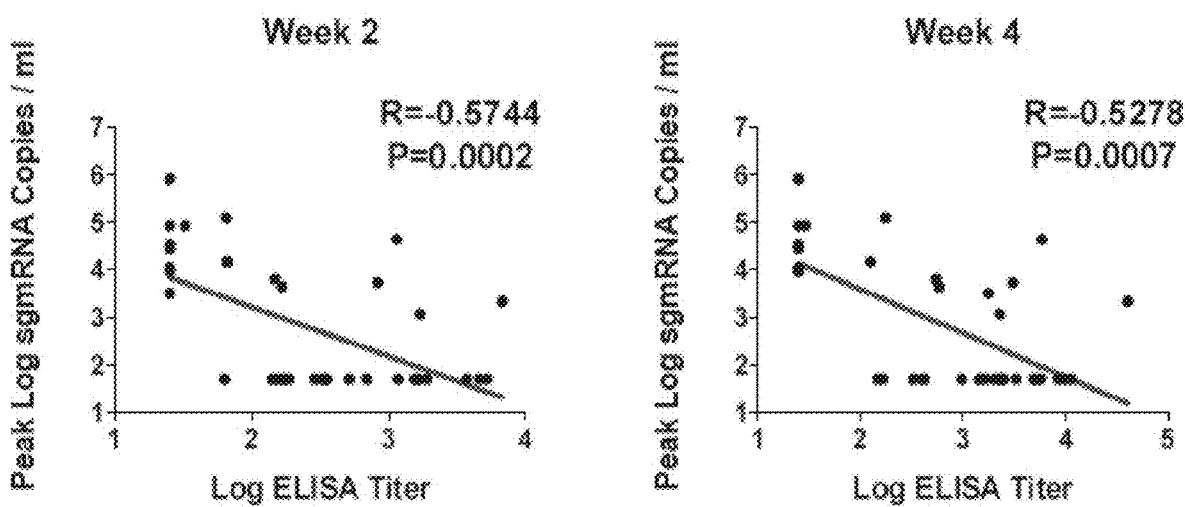
FIGS. 43A-43D are graphs showing antibody correlates of protection. Correlations of (FIG. 43A) binding ELISA titers, (FIG. 43B) pseudovirus NAb titers, and (FIG. 43C) live virus NAb titers at week 2 and week 4 with log peak sgmRNA copies/mL in BAL following challenge. Red lines reflect the best linear fit relationship between these variables. P and R values reflect two-sided Spearman rank-correlation tests.
Figure 43B:
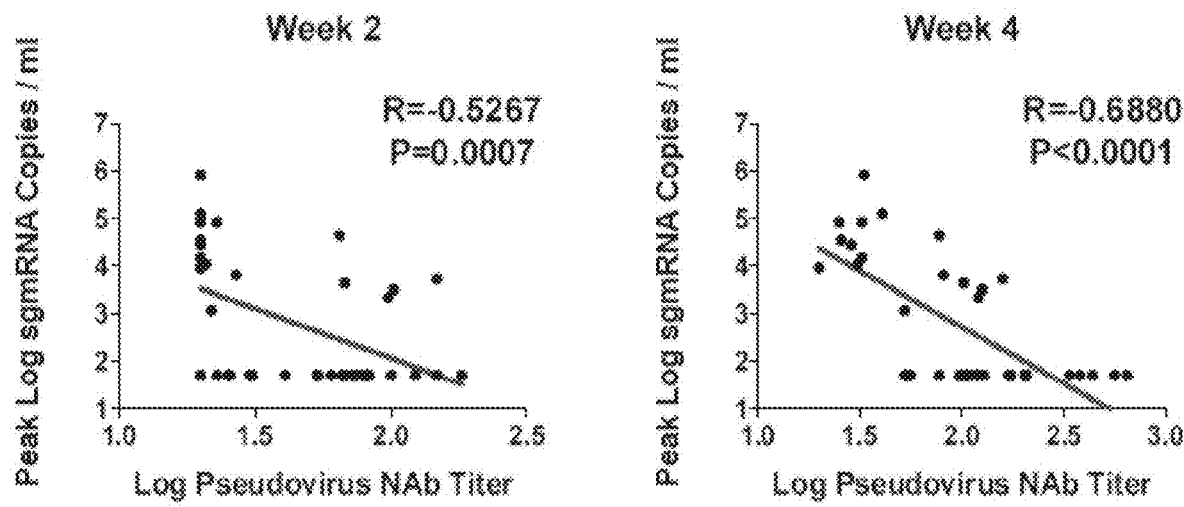
Figure 43C:
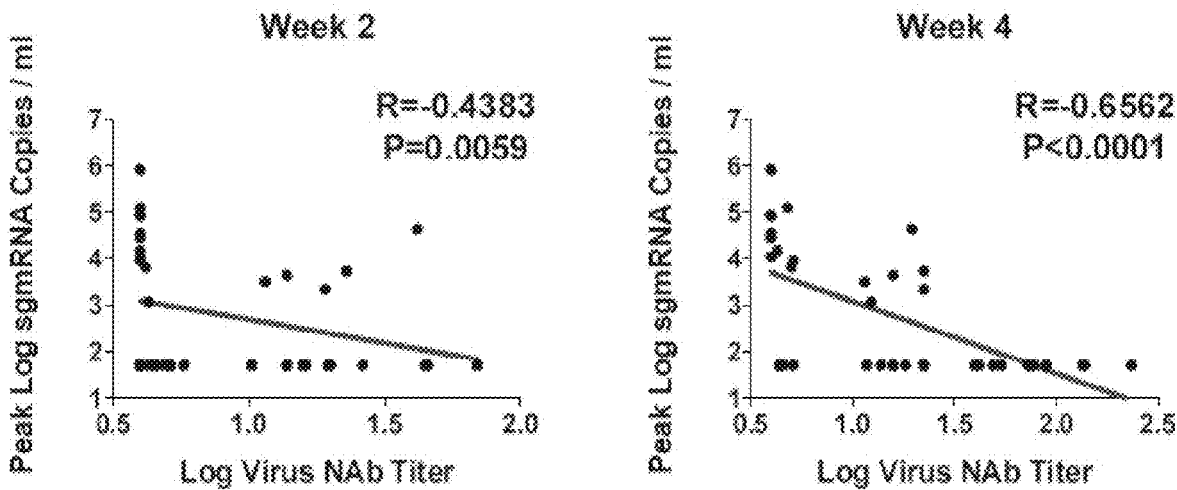
Figure 50:
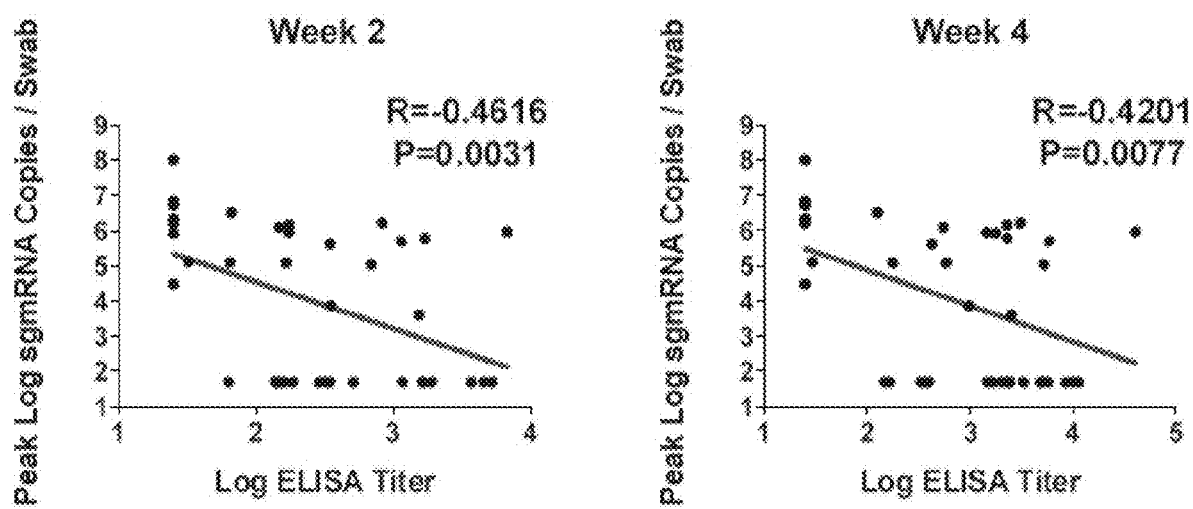
FIG. 50 is a pair of graphs showing ELISA correlates of protection. Correlations of binding ELISA titers at week 2 and week 4 with log peak sgmRNA copies/swab in NS following challenge. Red lines reflect the best linear fit relationship between these variables. P and R values reflect two-sided Spearman rank-correlation tests.

Seven Ad26 vectors expressing 2019-nCoV S variants that reflected different promoters, antigen forms, and stabilization mutations were produced: (i) tissue plasminogen activator (tPA) leader sequence with full-length S (tPA.S (SEQ ID NO: 1, with a tPA leader sequence fused to the N-terminus))[12], (ii) tPA leader sequence with full-length S with mutation of the furin cleavage site and two proline stabilizing mutations (tPA.S.PP (SEQ ID NO: 23, with a tPA leader sequence fused to the N-terminus))[13-15], (iii) wildtype leader sequence with native full-length S (S (SEQ ID NO: 29)), (iv) wildtype leader sequence with S with deletion of the cytoplasmic tail (S.dCT (SS-SdCT) (SEQ ID NO: 30))[16], (v) tandem tPA and wildtype leader sequences with full-length S (tPA.WT.S (SEQ ID NO: 29, with a tPA leader sequence fused to the N-terminus))[12], (vi) wildtype leader sequence with S with deletion of the transmembrane region and cytoplasmic tail, reflecting the soluble ectodomain, with mutation of the furin cleavage site, proline stabilizing mutations, and a foldon trimerization domain (S.dTM.PP (SS-S.Ecto-dF-PP-foldon) (SEQ ID NO: 56))[15], and (vii) wildtype leader sequence with full-length S with mutation of the furin cleavage site and proline stabilizing mutations (S.PP (SS-Spike-dF-PP) (SEQ ID NO: 51)) (FIG. 38*a*). Western blot analyses confirmed S expression in cell lysates from all vectors (FIG. 38*b*). 52 adult rhesus macaques, 6-12 years old, were immunized with Ad26 vectors expressing tPA.S (N=4), tPA.S.PP (N=4), S (N=4), S.dCT (SS-SdCT) (N=4), tPA.WT.S (N=4), S.dTM.PP (SS-S.Ecto-dF-PP-foldon) (N=6), S.PP (SS-Spike-dF-PP) (N=6), and sham controls (N=20). Animals received a single immunization of $10^{11}$ viral particles (vp) Ad26 vectors by the intramuscular route without adjuvant at week 0. RBD-specific binding antibodies were observed by ELISA in 31 of 32 vaccinated animals by week 2 and in all vaccinated animals by week 4 (FIG. 39*a*). Neutralizing antibody (NAb) responses were assessed using both a pseudovirus neutralization assay[9,10,16] (FIG. 39*b*) and a live virus neutralization assay[9,10,17,18] (FIG. 39*c*). NAb titers as measured by both assays were observed in the majority of vaccinated animals at week 2 and generally increased at week 4. The Ad26-S.PP (Ad26 SS-Spike-dF-PP) vaccine elicited the highest pseudovirus NAb titers (median 408; range 208-643) and live virus NAb titers (median 113; range 53-233) at week 4. Pseudovirus NAb titers correlated with both ELISA titers and live virus NAb titers (P<0.0001, R=0.8314 and P<0.0001, R=0.8427, respectively, two-sided Spearman rank-correlation tests; FIG. 45). Median NAb titers in the Ad26-S.PP vaccinated macaques were 4-fold higher than median NAb titers in previously reported cohorts of 9 convalescent macaques[9] and 27 convalescent humans following recovery from 2019-nCoV infection[10] (FIG. 46). The Ad26-S.PP vaccine also induced low but detectable S-specific IgG and IgA responses in bronchoalveolar lavage (BAL) (FIG. 47).

S-specific and RBD-specific antibody responses in the vaccinated animals were further characterized by systems serology[19]. A variety of Fc effector functions, including antibody-dependent neutrophil phagocytosis (ADNP), antibody-dependent monocyte cellular phagocytosis (ADCP), antibody-dependent complement deposition (ADCD), and antibody-dependent NK cell activation (ADNKA), as well as multiple Ig subclasses and FcR binding were observed (FIG. 39*d*, FIG. 48). The highest binding antibody responses were observed with the Ad26-tPA.S.PP and Ad26-S.PP vaccines, and the highest effector function responses were seen with the Ad26-S.PP vaccine. A principal component analysis showed substantial overlap of the vaccine groups, although Ad26-S.PP was the most divergent group (FIG. 39*d*).

Cellular immune responses were induced in 30 of 32 vaccinated animals at week 4 by IFN-γ ELISPOT assays using pooled S peptides (FIG. 40*a*). Multiparameter intracellular cytokine staining assays were utilized to assess IFN-γ+CD4+ and CD8+ T cell responses (FIG. 40*b*). Responses were comparable in most vaccine groups, although there was a trend towards lower cellular immune responses with the Ad26-S.PP vaccine. IFN-γ+ and IL-2+ CD4+ T cell responses were higher than IL-4+ and IL-10+ CD4+ T cell responses (FIG. 49) for the Ad26-S.dTM.PP (Ad26 SS-S.Ecto-dF-PP-foldon) and Ad26-S.PP vaccines, suggesting induction of Th1-biased responses.

Protective Efficacy of Ad26 Vaccine Candidates

At week 6, all animals were challenged with $1.2\times10^8$ VP ($1.1\times10^4$ PFU) 2019-nCoV by the intranasal (IN) and intratracheal (IT) routes[9,10]. Viral loads in bronchoalveolar lavage (BAL) and nasal swabs (NS) were assessed by RT-PCR for subgenomic mRNA (sgmRNA), which is believed to measure replicating virus[9,20]. All 20 sham controls were infected and showed a median peak of 4.89 (range 3.85-6.51) $\log_{10}$ sgmRNA copies/mL in BAL (FIG. 41*a*). In contrast, animals that received Ad26-S.PP (Ad26 SS-Spike-dF-PP) demonstrated no detectable virus in BAL (limit of quantitation 1.69 $\log_{10}$ sgmRNA copies/mL). Substantial protection was also observed with the other vaccines, although occasional animals showed low levels of sgmRNA in BAL (FIG. 41*b*). Similarly, sham controls showed a median peak of 5.59 (range 3.78-8.01) $\log_{10}$ sgmRNA in NS (FIG. 41*c*). Only one of the animals that received the Ad26-S.PP vaccine showed a low amount of virus in NS. The animals that received the other vaccines generally demonstrated reduced viral loads in NS compared with controls, although protection was optimal with Ad26-S.PP (FIG. 41*d*).

A comparison of peak viral loads in the vaccinated animals suggested that protection in BAL was generally more robust than in NS (FIG. 42). The Ad26-S.PP vaccine provided complete protection in both the lower and upper respiratory tract with the exception of one animal that showed a low amount of virus in NS, and resulted in >3.2 and >3.9 $\log_{10}$ reductions of median peak sgmRNA in BAL and NS, respectively, as compared with sham controls (P<0.0001 and P<0.0001, respectively, two-sided Mann-Whitney tests) (FIG. 42). Among the 32 vaccinated macaques, 17 animals were completely protected and had no detectable sgmRNA in BAL or NS following challenge, and 5 additional animals had no sgmRNA in BAL but showed some virus in NS.

Immune Correlates of Protection

The size of this study and the variability in outcomes with the different vaccine constructs facilitated an immune correlates analysis. The $\log_{10}$ ELISA titer, pseudovirus NAb titer, and live virus NAb titer at week 2 and week 4 inversely correlated with peak $\log_{10}$ sgmRNA in both BAL (FIG. 43)

and NS (FIGS. 50-52). In general, week 4 titers correlated better than week 2 titers, and NAb titers correlated better than ELISA titers. The $\log_{10}$ pseudovirus NAb titer and live virus NAb titer at week 4 inversely correlated with peak $\log_{in}$ sgmRNA in BAL (P<0.0001, R=−0.6880 and P<0.0001, R=−0.6562, respectively, two-sided Spearman rank-correlation test) (FIG. 43b-c) and in NS (P<0.0001, R=−0.5839, and P<0.0001, R=−0.5714, respectively, two-sided Spearman rank-correlation test) (FIGS. 51 and 52). Together with previously published data[10], these findings suggest that serum antibody titers may prove a useful immune correlate of protection for 2019-nCoV vaccines. By contrast, vaccine-elicited ELISPOT responses, CD4+ ICS responses, and CD8+ ICS responses did not correlate with protection.

Figure 43D:
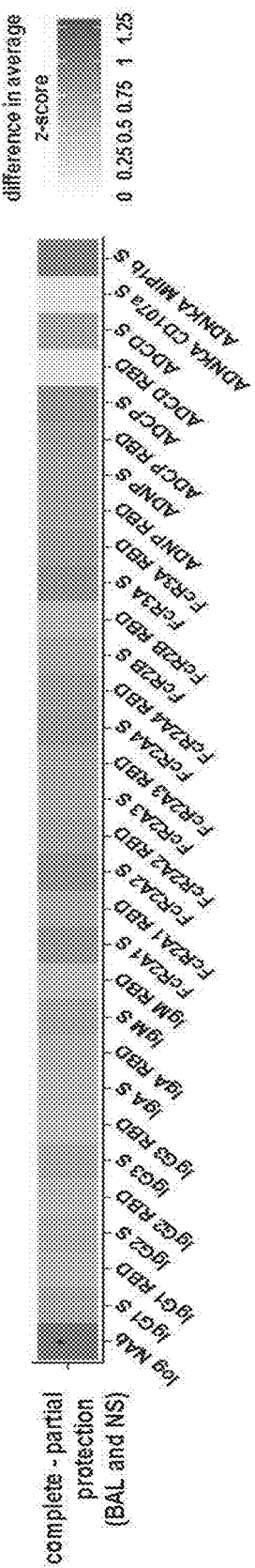

To gain further insight into antibody correlates of protection, antibody parameters that distinguished completely protected animals (defined as animals with no detectable sgmRNA in BAL or NS following challenge) and partially protected or non-protected animals were defined. The NAb titer was the parameter most enriched in completely protected animals compared with partially protected or non-protected animals (P=0.0009, two-sided Mann-Whitney test), followed by ADNKA (P=0.0044) and ADCP (P=0.0092) responses (FIG. 43d, FIG. 53). Moreover, a logistic regression analysis showed that utilizing two features, such as NAb titers and FcγR2A-3, IgM, or ADCD responses, improved correlation with protection (FIG. 43d). These data suggest that NAbs are primarily responsible for protection against 2019-nCoV but that other binding and functional antibodies may also play a role.

Immune Responses in Vaccinated Animals Following Challenge

Figure 41A:
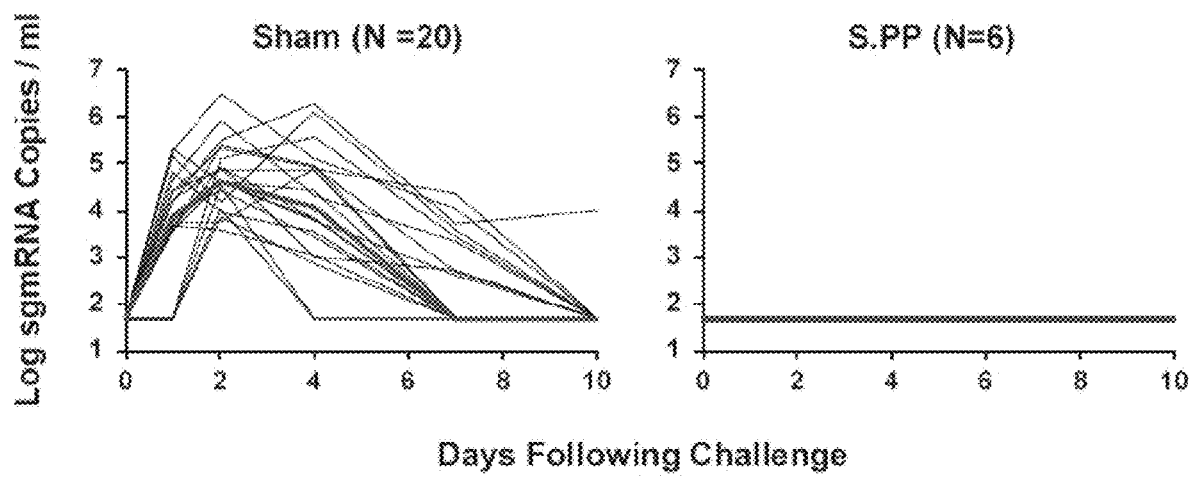
Figure 41B:
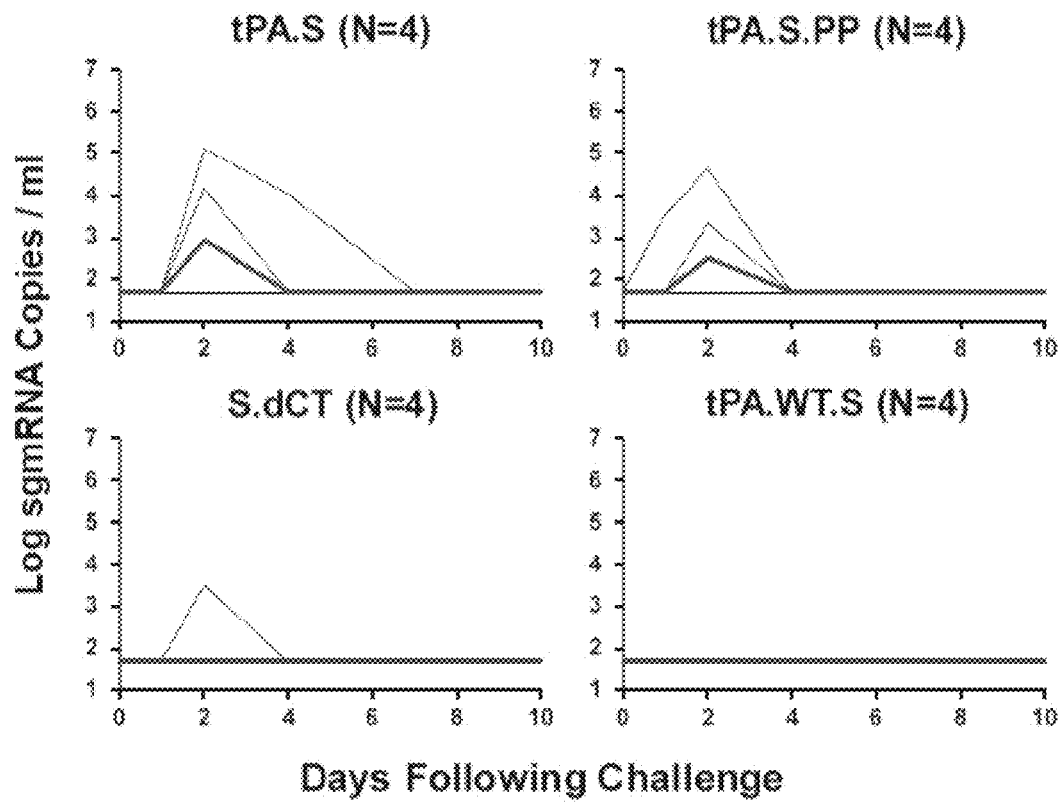
Figure 41D:
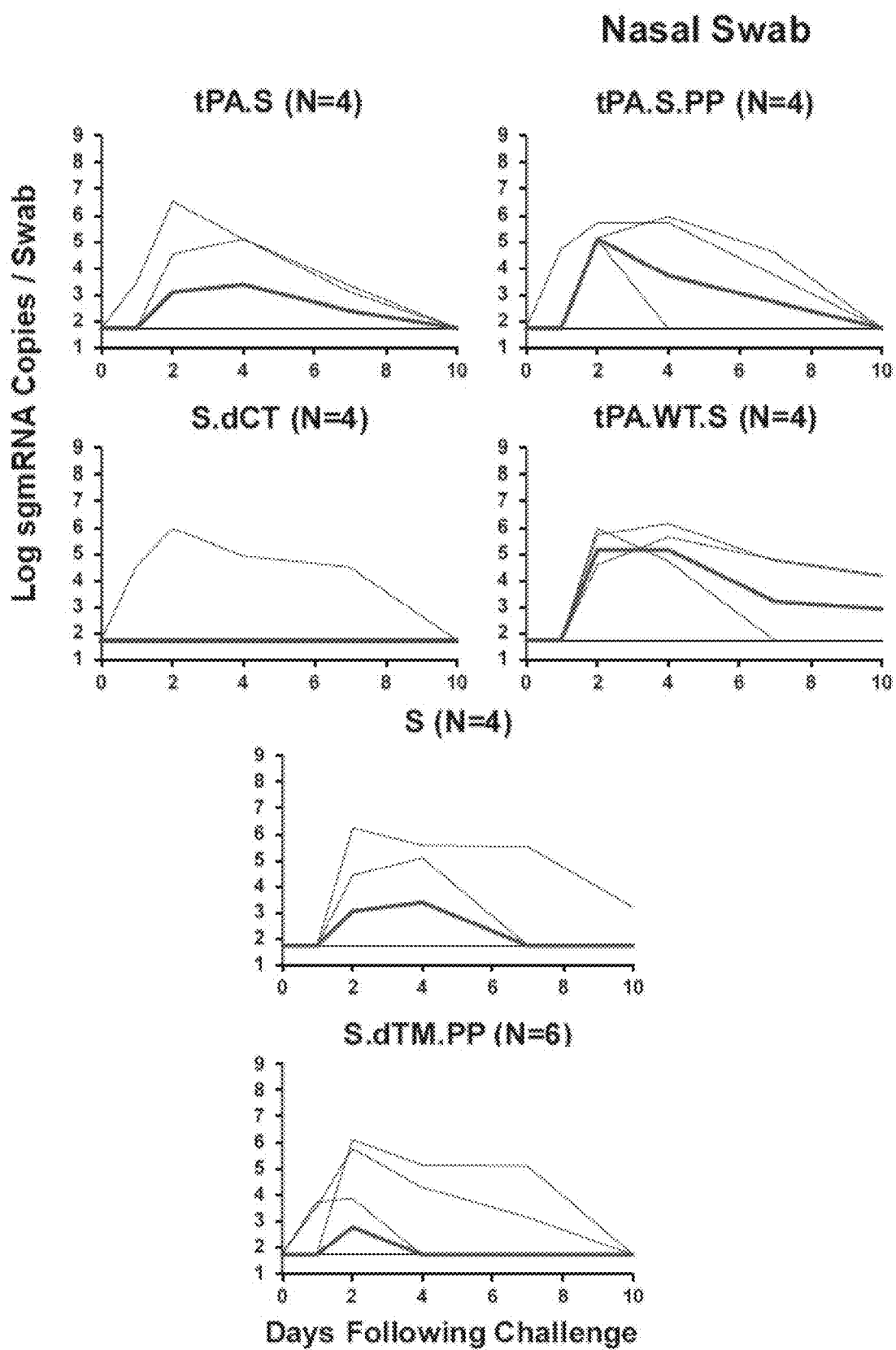
Figure 42:
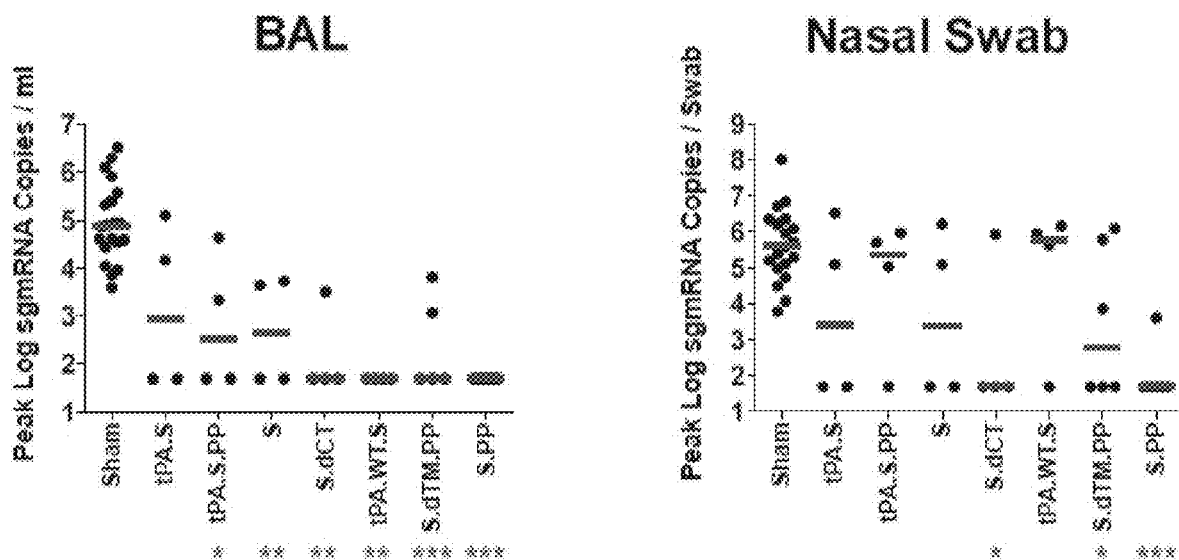
FIG. 42 is a graph showing summary of peak viral loads following SARS-CoV-2 challenge. Peak viral loads in BAL and NS following challenge. Peak viral loads occurred variably on day 1-4 following challenge. Red lines reflect median viral loads. P-values indicate two-sided Mann-Whitney tests (*P<0.05, P<0.001, *P<0.0001).
Figure 44B:
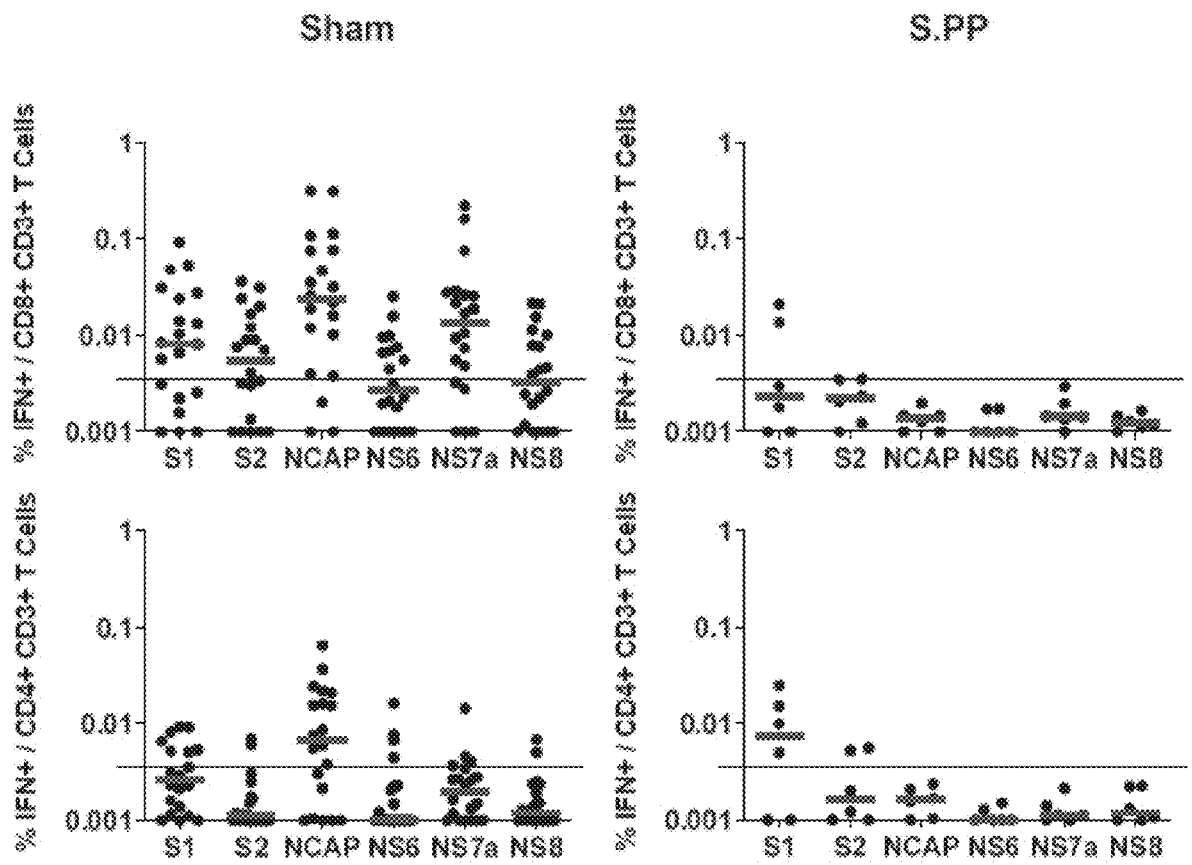

Sham controls and most of the vaccinated animals developed substantially higher pseudovirus NAb responses (FIG. 44a, FIG. 54) as well as CD8+ and CD4+ T cell responses (FIG. 44b) by day 14 following 2019-nCoV challenge. CD8+ and CD4+ T cell responses were directed against multiple 2019-nCoV proteins, including spike (S1, S2), nucleocapsid (NCAP), and non-structural proteins (NS6, NS7a, NS8), in these animals (FIG. 44b). In contrast, animals that received the Ad26-S.PP (Ad26 SS-Spike-dF-PP) vaccine did not demonstrate anamnestic NAb responses (FIG. 44a) and only showed low T cell responses against spike (S1, S2) (FIG. 44b), which was the vaccine antigen, following challenge. These findings are consistent with the largely undetectable viral loads in the Ad26-S.PP vaccinated animals (FIGS. 41 and 42) and suggest exceedingly low levels of virus replication in these animals, if any at all, following challenge.

Discussion

The development of a safe and effective 2019-nCoV vaccine is a critical global priority. These data demonstrate that a single immunization with an Ad26 vector expressing a prefusion stabilized S immunogen induced robust NAb responses and provided complete or near-complete protection against 2019-nCoV challenge in rhesus macaques. An optimal vaccine evaluated in this study was Ad26-S.PP (Ad26 SS-Spike-dF-PP), which contains the wildtype leader sequence, the full-length membrane-bound S, mutation of the furin cleavage site, and two proline stabilizing mutations[15].

These data extend recent preclinical studies of inactivated virus vaccines and DNA vaccines for 2019-nCoV in non-human primates[10,21]. Inactivated virus vaccines, nucleic acid vaccines, and protein subunit vaccines typically require two or more immunizations, whereas adenovirus vectors can induce robust and durable NAb responses after a single immunization[22-24]. A single-shot 2019-nCoV vaccine would have important logistic and practical advantages compared with a two-dose vaccine for mass vaccination campaigns and pandemic control. However, a homologous boost with Ad26-HIV vectors can augment antibody titers by more than 10-fold in both nonhuman primates and humans[25-27], suggesting that both single-dose and two-dose regimens of the Ad26-S.PP vaccine can be effective approaches.

Ad26-S.PP induced robust NAb responses after a single immunization and provided complete protection against 2019-nCoV challenge, except for one animal that had low levels of virus in NS. Moreover, NAb titers and T cell responses in Ad26-S.PP vaccinated animals did not expand following challenge, and T cell responses also did not broaden to non-vaccine antigens, such as nucleocapsid and non-structural proteins. In contrast, sham controls and the other vaccines generated higher NAb titers and T cell responses to multiple 2019-nCoV proteins following challenge, consistent with previous observations with DNA vaccines[10]. These data suggest minimal to no virus replication in the Ad26-S.PP vaccinated animals following 2019-nCoV challenge, likely related to the higher NAb responses in these animals.

Vaccine-elicited NAb titers prior to challenge correlated with protection in both BAL and NS following challenge, consistent with previous findings[10]. These data suggest that serum NAb titers may be a potential biomarker for vaccine protection, although this will need to be confirmed in additional 2019-nCoV vaccine efficacy studies in both non-human primates and humans. Moreover, additional functional antibody responses may also contribute to protection, such as ADNKA, ADCP, and ADCD responses. The role of T cell responses in vaccine protection remains to be determined, and the trend towards lower cellular immune responses with Ad26-S.PP as compared with the other vectors will require further investigation.

The Ad26-S.dTM.PP (Ad26 SS-S.Ecto-dF-PP-foldon) and Ad26-S.PP vaccines elicited Th1-biased rather than Th2-biased CD4+ T cell responses, and animals that had sub-protective NAb titers did not demonstrate enhanced viral replication or clinical disease. This is evidence against the possibility of antibody-dependent enhancement of infection[28].

In summary, these data demonstrate that a single immunization of Ad26 vector-based vaccines for 2019-nCoV elicited robust NAb titers and provided complete or near-complete protection against 2019-nCoV challenge in rhesus macaques. The identification of a NAb correlate of protection confirms the efficacy of these 2019-nCoV vaccines for clinical use. An optimal Ad26-S.PP vaccine from this study, termed Ad26.COV2.S, is likely to be effective in humans.

REFERENCES

1 Wu, F. et al. A new coronavirus associated with human respiratory disease in China. Nature 579, 265-269, doi: 10.1038/s41586-020-2008-3 (2020).

2 Zhou, P. et al. A pneumonia outbreak associated with a new coronavirus of probable bat origin. Nature 579, 270-273, doi:10.1038/s41586-020-2012-7 (2020).

3 Holshue, M. L. et al. First Case of 2019 Novel Coronavirus in the United States. N Engl J Med 382, 929-936, doi: 10.1056/NEJMoa2001191 (2020).

4 Li, Q. et al. Early Transmission Dynamics in Wuhan, China, of Novel Coronavirus-Infected Pneumonia. N Engl J Med, doi:10.1056/NEJMoa2001316 (2020).

5 Zhu, N. et al. A Novel Coronavirus from Patients with Pneumonia in China, 2019. N Engl J Med 382, 727-733, doi:10.1056/NEJMoa2001017 (2020).
6 Chen, N. et al. Epidemiological and clinical characteristics of 99 cases of 2019 novel coronavirus pneumonia in Wuhan, China: a descriptive study. Lancet 395, 507-513, doi:10.1016/S0140-6736(20)30211-7 (2020).
7 Huang, C. et al. Clinical features of patients infected with 2019 novel coronavirus in Wuhan, China. Lancet 395, 497-506, doi:10.1016/S0140-6736(20)30183-5 (2020).
8 Chan, J. F. et al. A familial cluster of pneumonia associated with the 2019 novel coronavirus indicating person-to-person transmission: a study of a family cluster. Lancet 395, 514-523, doi:10.1016/S0140-6736(20)30154-9 (2020).
9 Chandrashekar, A. et al. SARS-CoV-2 infection protects against rechallenge in rhesus macaques. Science, doi:10.1126/science.abc4776 (2020).
10 Yu, J. et al. DNA vaccine protection against SARS-CoV-2 in rhesus macaques. Science, doi:10.1126/science.abc6284 (2020).
11 Abbink, P. et al. Comparative seroprevalence and immunogenicity of six rare serotype recombinant adenovirus vaccine vectors from subgroups B and D. J Virol 81, 4654-4663, doi:JVI.02696-06 [pii] 10.1128/JVI.02696-06 (2007).
12 Alharbi, N. K. et al. ChAdOx1 and MVA based vaccine candidates against MERS-CoV elicit neutralising antibodies and cellular immune responses in mice. Vaccine 35, 3780-3788, doi:10.1016/j.vaccine.2017.05.032 (2017).
13 Kirchdoerfer, R. N. et al. Pre-fusion structure of a human coronavirus spike protein. Nature 531, 118-121, doi:10.1038/nature17200 (2016).
14 Pallesen, J. et al. Immunogenicity and structures of a rationally designed prefusion MERS-CoV spike antigen. Proc Natl Acad Sci USA 114, E7348-E7357, doi:10.1073/pnas.1707304114 (2017).
15 Wrapp, D. et al. Cryo-EM structure of the 2019-nCoV spike in the prefusion conformation. Science 367, 1260-1263, doi:10.1126/science.abb2507 (2020).
16 Yang, Z. Y. et al. A DNA vaccine induces SARS coronavirus neutralization and protective immunity in mice. Nature 428, 561-564, doi:10.1038/nature02463 (2004).
17 Scobey, T. et al. Reverse genetics with a full-length infectious cDNA of the Middle East respiratory syndrome coronavirus. Proc Natl Acad Sci USA 110, 16157-16162, doi:10.1073/pnas.1311542110 (2013).
18 Yount, B. et al. Reverse genetics with a full-length infectious cDNA of severe acute respiratory syndrome coronavirus. Proc Natl Acad Sci USA 100, 12995-13000, doi:10.1073/pnas.1735582100 (2003).
19 Chung, A. W. et al. Dissecting Polyclonal Vaccine-Induced Humoral Immunity against HIV Using Systems Serology. Cell 163, 988-998, doi:10.1016/j.cell.2015.10.027 (2015).
20 Wolfel, R. et al. Virological assessment of hospitalized patients with COVID-2019. Nature, doi:10.1038/s41586-020-2196-x (2020).
21 Gao, Q. et al. Rapid development of an inactivated vaccine candidate for SARS-CoV-2. Science, doi:10.1126/science.abc1932 (2020).
22 Abbink, P. et al. Durability and correlates of vaccine protection against Zika virus in rhesus monkeys. Sci Transl Med 9, doi:10.1126/scitranslmed.aao4163 (2017).
23 Abbink, P. et al. Protective efficacy of multiple vaccine platforms against Zika virus challenge in rhesus monkeys. Science 353, 1129-1132, doi:10.1126/science.aah6157 (2016).
24 Cox, F. et al. Adenoviral vector type 26 encoding Zika virus (ZIKV) M-Env antigen induces humoral and cellular immune responses and protects mice and nonhuman primates against ZIKV challenge. PLoS ONE 13, e0202820, doi:10.1371/journal.pone.0202820 (2018).
25 Barouch, D. H. et al. Evaluation of a mosaic HIV-1 vaccine in a multicentre, randomised, double-blind, placebo-controlled, phase 1/2a clinical trial (APPROACH) and in rhesus monkeys (NHP 13-19). Lancet 392, 232-243, doi:10.1016/S0140-6736(18)31364-3 (2018).
26 Barouch, D. H. et al. Protective efficacy of adenovirus/protein vaccines against SIV challenges in rhesus monkeys. Science 349, 320-324, doi:10.1126/science.aab3886 (2015).
27 Baden, L. R. et al. First-in-human evaluation of the safety and immunogenicity of a recombinant adenovirus serotype 26 HIV-1 Env vaccine (IPCAVD 001). J Infect Dis 207, 240-247, doi:10.1093/infdis/jis670 (2013).
28 Graham, B. S. Rapid COVID-19 vaccine development. Science, doi:10.1126/science.abb8923 (2020).
29 Brown, E. P. et al. Multiplexed Fc array for evaluation of antigen-specific antibody effector profiles. J Immunol Methods 443, 33-44, doi:10.1016/j.jim.2017.01.010 (2017).
30 Ackerman, M. E. et al. A robust, high-throughput assay to determine the phagocytic activity of clinical antibody samples. J Immunol Methods 366, 8-19, doi:10.1016/j.jim.2010.12.016 (2011).
31 Lu, L. L. et al. A Functional Role for Antibodies in Tuberculosis. Cell 167, 433-443 e414, doi:10.1016/j.cell.2016.08.072 (2016).
32 Fischinger, S. et al. A high-throughput, bead-based, antigen-specific assay to assess the ability of antibodies to induce complement activation. J Immunol Methods 473, 112630, doi:10.1016 1j.jim.2019.07.002 (2019).

Example 12. A Single-Dose Vaccine Protects Against 2019-nCoV Severe Clinical Disease in Hamsters COVID-19 disease in humans is often a clinically mild illness, but some individuals develop severe pneumonia, respiratory failure, and death[1-4]. Studies of SARS-CoV-2 (2019-nCoV) infection in hamsters[5-7] and nonhuman primates[8-10] have generally reported mild clinical disease, and preclinical SARS-CoV-2 vaccine studies have demonstrated reduction of viral replication in the upper and lower respiratory tracts in nonhuman primates[11-13].

As is discussed below, high-dose intranasal SARS-CoV-2 infection in hamsters results in severe clinical disease, including high levels of virus replication in tissues, extensive pneumonia, weight loss, and mortality in a subset of animals. A single immunization with an adenovirus serotype 26 (Ad26) vector-based vaccine expressing a nucleotide (SS-Spike-dF-PP, SEQ ID NO: 204) encoding a stabilized SARS-CoV-2 spike (S) protein (SS-Spike-dF-PP, SEQ ID NO: 51) elicited binding and neutralizing antibody responses and protected against SARS-CoV-2 induced weight loss, pneumonia, and mortality. These data demonstrate vaccine protection against SARS-CoV-2 clinical disease. This model should prove useful for preclinical studies of SARS-CoV-2 vaccines, therapeutics, and pathogenesis.

Materials and Methods

Animals and study design. 70 male and female Syrian golden hamsters (Envigo), 10-12 weeks old were randomly allocated to groups. All animals were housed at Bioqual, Inc. (Rockville, Md.). Animals received Ad26 vectors expressing a nucleotide (SS-S.Ecto-dF-PP-foldon, SEQ ID NO: 195) encoding S.dTM.PP (SS-S.Ecto-dF-PP-foldon, SEQ ID NO: 56) or a nucleotide (SS-Spike-dF-PP, SEQ ID NO: 204) encoding S.PP (SS-Spike-dF-PP, SEQ ID NO: 51) or sham controls (N=10/group). Animals received a single immunization of $10^{10}$ or $10^9$ viral particles (vp) Ad26 vectors by the intramuscular route without adjuvant at week 0. At week 4, all animals were challenged with $5.0 \times 10^5$ $TCID_{50}$ ($6 \times 10^8$ VP, $5.5 \times 10^4$ PFU) or $5.0 \times 10^4$ $TCID_{50}$ ($6 \times 10^7$ VP, $5.5 \times 10^3$ PFU) SARS-CoV-2, which was derived with 1 passage from USA-WA1/2020 (NR-52281; BEI Resources)[10]. Virus was administered as 100 µL by the intranasal (IN) route (50 µL in each nare). Body weights were assessed daily. All immunologic and virologic assays were performed blinded. On day 4, a subset of animals was euthanized for tissue viral loads and pathology. All animal studies were conducted in compliance with all relevant local, state, and federal regulations and were approved by the Bioqual Institutional Animal Care and Use Committee (IACUC).

Ad26 vectors. Ad26 vectors were constructed with two variants of the SARS-CoV-2 spike (S) protein sequence (Wuhan/WIV04/2019; Genbank MN996528.1). Sequences were codon optimized and synthesized. Replication-incompetent, E1/E3-deleted Ad26-vectors[19] were produced in PER.C6.TetR cells using a plasmid containing the full Ad26 vector genome and a transgene expression cassette. Sham controls included Ad26-Empty vectors. Vectors were sequenced and tested for expression prior to use.

Histopathology and immunohistochemistry. Tissues were fixed in freshly prepared 4% paraformaldehyde for 24 h, transferred to 70% ethanol, paraffin embedded within 7-10 days, and blocks sectioned at 5 µm. Slides were baked for 30-60 min at 65° C. then deparaffinized in xylene and rehydrated through a series of graded ethanol to distilled water. For SARS-CoV-N, Iba-1, and CD3 IHC, heat induced epitope retrieval (HIER) was performed using a pressure cooker on steam setting for 25 min in citrate buffer (Thermo; AP-9003-500) followed by treatment with 3% hydrogen peroxide. Slides were then rinsed in distilled water and protein blocked (BioCare, BE965H) for 15 min followed by rinses in 1× phosphate buffered saline. Primary rabbit anti-SARS-CoV-nucleoprotein antibody (Novus; NB100-56576 at 1:500 or 1:1000), rabbit anti-Iba-1 antibody (Wako; 019-19741 at 1:500), or rabbit anti-CD3 (Dako; A0452 at 1:300) was applied for 30 minutes followed by rabbit Mach-2 HRP-Polymer (BioCare; RHRP520L) for 30 min then counterstained with hematoxylin followed by bluing using 0.25% ammonia water. Labeling for SARS-CoV-N, Iba-1, and CD3 were performed on a Biogenex i6000 Autostainer (v3.02). In some cases, CD3, Iba-1, and ACE-2 staining was performed with CD3 at 1:400 (Thermo Cat. No. RM-9107-S; clone SP7), Iba-1 at 1:500 (BioCare Cat. No. CP290A; polyclonal), or ACE-2 (Abcam; ab108252), all of which were detected by using Rabbit Polink-1 HRP (GBI Labs Cat. No. D13-110). Neutrophil (MPO) and type 1 IFN response (Mx1) was performed with MPO (Dako Cat. No. A0398; polyclonal) at 1:1000 detection using Rabbit Polink-1 HRP, and Mx1 (EMD Millipore Cat. No. MABF938; clone M143/CL143) at 1:1000 detection using Mouse Polink-2 HRP (GBI Labs Cat. No. D37-110). Staining for CD3, Iba-1, MPO, and Mx1 IHC was performed as previously described using a Biocare intelliPATH autostainer, with all antibodies being incubated for 1 h at room temperature. Tissue pathology was assessed independently by two veterinary pathologists.

RNASCOPE® in situ hybridization. RNASCOPE® in situ hybridization was performed as previously described[10] using SARS-CoV2 anti-sense specific probe v-nCoV2019-S (ACD Cat. No. 848561) targeting the positive-sense viral RNA and SARS-CoV2 sense specific probe v-nCoV2019-orf1ab-sense (ACD Cat. No. 859151) targeting the negative-sense genomic viral RNA. In brief, after slides were deparaffinized in xylene and rehydrated through a series of graded ethanol to distilled water, retrieval was performed for 30 min in ACD P2 retrieval buffer (ACD Cat. No. 322000) at 95-98° C., followed by treatment with protease III (ACD Cat. No. 322337) diluted 1:10 in PBS for 20 min at 40° C. Slides were then incubated with 3% $H_2O_2$ in PBS for 10 min at room temperature. Prior to hybridization, probes stocks were centrifuged at 13,000 rpm using a microcentrifuge for 10 min, then diluted 1:2 in probe diluent (ACD Cat. No. 300041) to reduce probe aggregation tissue artifacts. Slides were developed using the RNASCOPE® 2.5 HD Detection Reagents-RED (ACD Cat. No. 322360).

Quantitative image analysis. Quantitative image analysis was performed using HALO software (v2.3.2089.27 or v3.0.311.405; Indica Labs) on at least one lung lobe cross section from each animal. In cases where >1 cross-section was available, each lung lobe was quantified as an individual data point. For SARS-CoV-N the Multiplex IHC v2.3.4 algorithm was used with an exclusion screen for acid hematin to determine the percentage of SAR-N protein positive cells as a proportion of the total number of cells. For Iba-1, the Multiplex IHC v2.3.4 algorithm was used for quantitation. For SARS-CoV-2 RNASCOPE® ISH and Mx1 quantification, the Area Quantification v2.1.3 module was used to determine the percentage of total SARS-CoV-2 antisense or sense probe, or Mx1 protein as a proportion of the total tissue area. For MPO (neutrophil) and CD3+ cell quantification, slides were annotated to exclude blood vessels (>5 $mm^2$), bronchi, bronchioles, cartilage, and connective tissue; subsequently, the Cytonuclear v1.6 module was used to detect MPO+ or CD3+ cells and calculated as a proportion of total alveolar tissue (PMNs/$mm^2$), which was determined by running the Area Quantification v2.1.3 module. In all instances, manual inspection of all images was performed on each sample to ensure the annotations were accurate.

Subgenomic mRNA assay. SARS-CoV-2 E gene subgenomic mRNA (sgmRNA) was assessed by RT-PCR using primers and probes as previously described[10,11,23]. Briefly, total RNA was extracted from tissue homogenates from several anatomical sites using a QIAcube HT (Qiagen) and RNeasy 96 QIAcube HT Kit (Qiagen). A standard curve was generated using the SARS-CoV-2 E gene sgmRNA by cloning into a pcDNA3.1 expression plasmid; this insert was transcribed using an AmpliCap-Max T7 High Yield Message Maker Kit (Cellscript). Prior to RT-PCR, samples collected from challenged animals or standards were reverse-transcribed using Superscript III VILO (Invitrogen) according to the manufacturer's instructions. A Taqman custom gene expression assay (ThermoFisher Scientific) was designed using the sequences targeting the E gene sgmRNA. Reactions were carried out on QuantStudio 6 and 7 Flex Real-Time PCR Systems (Applied Biosystems) according to the manufacturer's specifications. Standard curves were used to calculate sgmRNA copies per gram tissue; the quantitative assay sensitivity was 100 copies.

ELISA. RBD-specific binding antibodies were assessed by ELISA essentially as described[10,11]. Briefly, 96-well plates were coated with 1 μg/mL SARS-CoV-2 RBD protein (Aaron Schmidt, MassCPR) or 1 μg/mL SARS-CoV-2 spike (S) protein (Sino Biological) in 1×DPBS and incubated at 4° C. overnight. After incubation, plates were washed once with wash buffer (0.05% Tween20 in 1×DPBS) and blocked with 350 μL casein block/well for 2-3 h at room temperature. After incubation, block solution was discarded and plates were blotted dry. Threefold serial dilutions of heat-inactivated serum in casein block were added to wells and plates were incubated for 1 h at room temperature, plates were washed three times then subsequently incubated for 1 h with 0.1 μg/mL of anti-hamster IgG HRP (Southern Biotech) in casein block, at room temperature in the dark. Plates were washed three times, then 100 μL of SERACARE® KPL TMB SUREBLUE® Start solution was added to each well; plate development was halted by the addition of 100 μL SERACARE® KPL TMB Stop solution per well. The absorbance at 450 nm was recorded using a VERSAMAX™ or OMEGA® microplate reader. ELISA endpoint titers were defined as the highest reciprocal serum dilution that yielded an absorbance 2-fold above background.

Pseudovirus neutralization assay. The SARS-CoV-2 pseudoviruses expressing a luciferase reporter gene were generated in an approach similar to as described previously[10,11,21]. Briefly, the packaging construct psPAX2 (AIDS Resource and Reagent Program), luciferase reporter plasmid pLenti-CMV Puro-Luc (Addgene), and spike protein expressing pcDNA3.1-SARS CoV-2 SΔCT were co-transfected into HEK293T cells by lipofectamine 2000 (ThermoFisher). The supernatants containing the pseudotype viruses were collected 48 h post-transfection; pseudotype viruses were purified by filtration with 0.45 μm filter. To determine the neutralization activity of the antisera from vaccinated animals, HEK293T-hACE2 cells were seeded in 96-well tissue culture plates at a density of $1.75 \times 10^4$ cells/well overnight. Three-fold serial dilutions of heat inactivated serum samples were prepared and mixed with 50 μL of pseudovirus. The mixture was incubated at 37° C. for 1 h before adding to HEK293T-hACE2 cells. 48 h after infection, cells were lysed in STEADY-GLO® Luciferase Assay (Promega) according to the manufacturer's instructions. SARS-CoV-2 neutralization titers were defined as the sample dilution at which a 50% reduction in RLU was observed relative to the average of the virus control wells.

Luminex. In order to detect relative quantity of antigen-specific antibody titers, a customized Luminex assay was performed as previously described[25]. Hereby, fluorescently labeled microspheres (Luminex) were coupled with SARS-CoV-2 antigens including spike protein (S) (Eric Fischer, Dana Farber Cancer Institute), S1 and S2 (Sino Biological), as well as Receptor Binding Domain (RBD) (Aaron Schmidt, Ragon Institute) via covalent N-hydroxysuccinimide (NHS)-ester linkages via EDC (Thermo Scientific) and Sulfo-NHS (Thermo Scientific). $1.2 \times 10^3$ beads per region and antigen were added to a 384-well plate (Greiner) and incubated with diluted serum (1:90 for IgG2a, IgG3, IgM; 1:500 for total IgG and Fc-receptor binding assays) for 16 h shaking at 900 rpm at 4° C. Following formation of immune complexes, microspheres were washed three times in 0.1% BSA and 0.05% Tween-20 (Luminex assay buffer) using an automated plate washer (Tecan). PE-labeled goat anti-mouse IgG, IgG2a, IgG3, and IgM detection antibodies (southern biotech) were diluted in Luminex assay buffer to 0.65 ug/mL and incubated with beads for 1 h at RT while shaking at 900 rpm. Similarly, for the Fc-receptor binding profiles, recombinant mouse FcγR2, FcγR3 and FcγR4 (Duke Protein Production facility) were biotinylated (Thermo Scientific) and conjugated to Streptavidin-PE for 10 min prior to addition to samples (Southern Biotech). These mouse antibodies and proteins are cross-reactive to hamster. The coated beads were then washed and read on a flow cytometer, iQue (Intellicyt) with a robot arm attached (PAA). Events were gated on each bead region, median fluorescence of PE for of bead positive events was reported. Samples were run in duplicate per each secondary detection agent.

Antibody-dependent complement deposition (ADCD). ADCD assays were performed as previously described[26]. Briefly, SARS-CoV-2 S and RBD were biotinylated (Thermo Fisher) and coupled to 1 μm red fluorescent neutravidin-beads (Thermo Fisher) for 2 h at 37° C., excess antigen was washed away afterwards. For the formation of immune complexes, $1.82 \times 10^8$ antigen-coated beads were added to each well of a 96-well round bottom plate and incubated with 1:10 diluted samples at 37° C. for 2 h. Lyophilized guinea pig complement was reconstituted according to manufacturer's instructions (Cedarlane) with water and 4 μL per well were added in gelatin veronal buffer containing Mg2+ and Ca2+(GVB++, Boston BioProducts) to the immune complexes for 20 min at 37° C. Immune complexes were washed with 15 mM EDTA in PBS, and fluorescein-conjugated goat IgG fraction to guinea pig complement C3 (MpBio) was added. sPost staining, samples were fixed with 4% paraformaldehyde (PFA) and sample acquisition was performed via flow cytometry (Intellicyt, iQue Screener plus) utilizing a robot arm (PAA). All events were gated on single cells and bead positive events, the median of C3 positive events is reported. All samples were run in duplicate on separate days.

Statistical analysis. Analysis of immunologic, virologic, and body weight data was performed using GraphPad Prism 8.4.2 (GraphPad Software). Comparison of data between groups was performed using two-sided Mann-Whitney tests. Mortality was assessed by two-sided Fisher's exact tests. Correlations were assessed by two-sided Spearman rank-correlation tests. P-values of less than 0.05 were considered significant. All systems serology data were login transformed. For the radar plots, each antibody feature was normalized such that its minimal value is 0 and the maximal value is 1 across groups before using the median within a group. A principal component analysis (PCA) was constructed using the R package 'ropls' to compare multivariate profiles. For the visualization in the heatmap, the differences in the means of the S.dTM.PP and S.PP groups of z-scored features were shown. To indicate significances in the heatmaps, a Benjamini-Hochberg correction was used to correct for multiple comparisons within a row.

Results and Discussion

SARS-CoV-2 can infect nonhuman primates[8-10], hamsters[5-7], ferrets[14-16], hACE2 transgenic mice[17,18], and other species[16], but clinical disease in these models has generally been mild. A severe pneumonia model would be useful for preclinical evaluation of SARS-CoV-2 vaccines and other countermeasures, since SARS-CoV-2 infection in humans can lead to severe clinical disease, respiratory failure, and mortality[1-4]. The clinical and virologic characteristics of high-dose SARS-CoV-2 infection in hamsters was assessed and the protective efficacy of an Ad26 vector-based vaccine[19] encoding a stabilized SARS-CoV-2 spike (S) was evaluated in this stringent model. 20 Syrian golden hamsters (10-12 weeks old) were inoculated with $5 \times 10^4$ TCID$_{50}$ (N=4; low-dose) or $5 \times 10^5$ TCID$_{50}$ (N=16; high-dose) SARS-CoV-2 by the intranasal route. In the high-dose group, 4 animals were necropsied on day 2, and 4 animals were necropsied on day 4 for tissue viral loads and histopathology, and the remaining 8 animals were followed longitudinally. All remaining animals were necropsied on day 14. In the low-dose group, hamsters lost a median of 14.7% of body weight by day 6 but fully recovered by day 14 (FIGS. 55A-B), consistent with previous studies[5-7]. In the high-dose group, hamsters lost a median of 19.9% of body weight by day 6. Of the 8 animals in this group that were followed longitudinally, 4 met IACUC humane euthanasia criteria of >20% weight loss and respiratory distress on day 6, and 2 additional animals met these criteria on day 7. The remaining 2 animals recovered by day 14. These data demonstrate that high-dose SARS-CoV-2 infection in hamsters led to severe weight loss and partial mortality.

Tissue viral loads were assessed in the 4 animals that received high-dose SARS-CoV-2 and were necropsied on day 2, the 4 animals that were necropsied on day 4, and 5 of 6 of the animals that met euthanasia criteria on day 6-7 (FIG. 55C). High median tissue viral loads on day 2 of $10^{12}$ RNA copies/g in lung tissue and $10^8$-$10^9$ RNA copies/g in nares and trachea were observed, with a median of $10^5$-$10^8$ RNA copies/g in heart, gastrointestinal tract, brain, spleen, liver, and kidney, indicative of disseminated infection. By day 6-7, tissue viral loads were approximately 2 logs lower, despite continued weight loss.

Figures 56A, 56B, 56C, 56D, 56E, 56F, 56G, 56H, 56I, 56J, 56K, 56L:
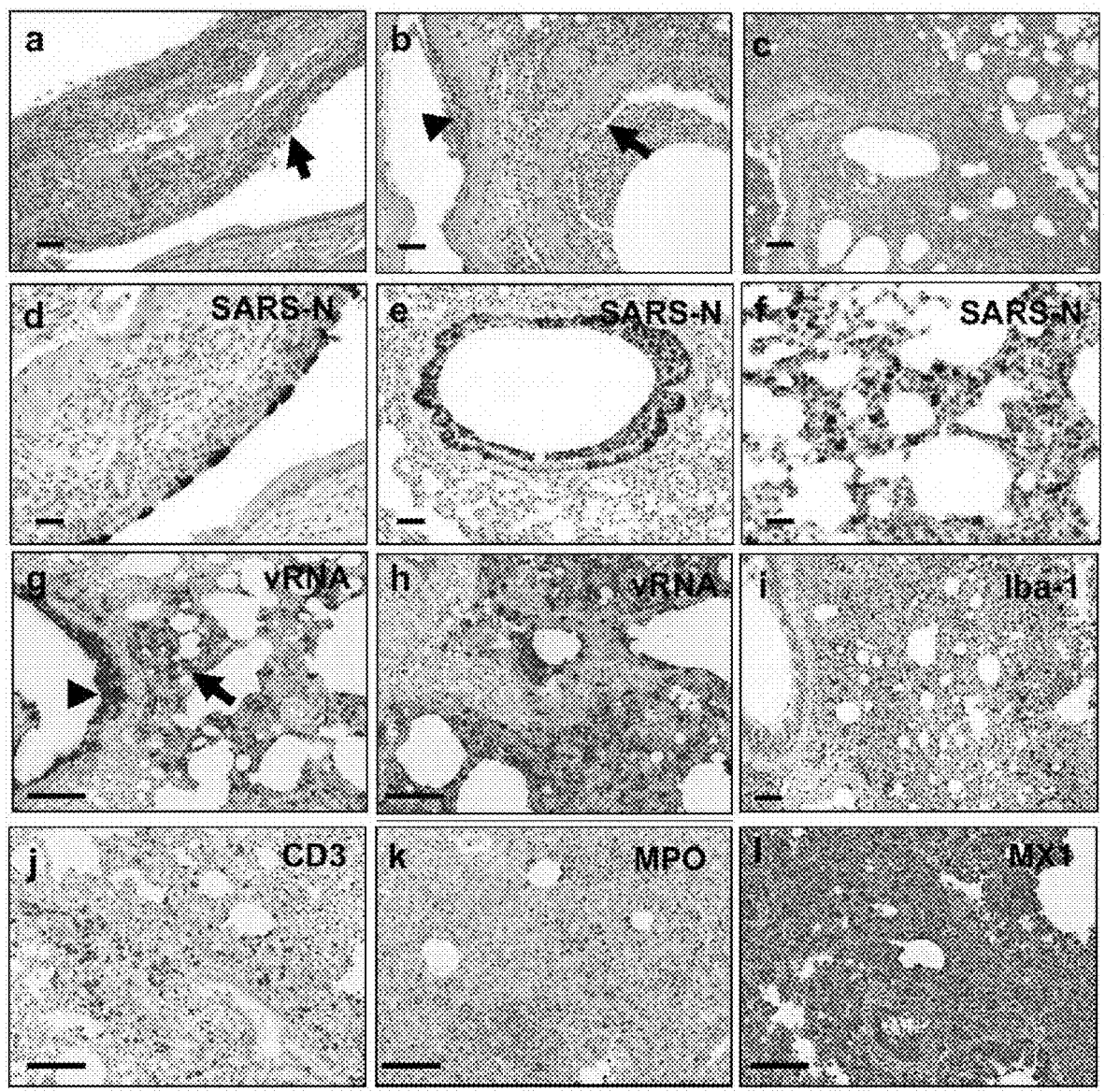

Hamsters infected with high-dose SARS-CoV-2 were assessed by histopathology on days 2 (N=4), 4 (N=4), 6-7 (N=6), and 14 (N=2). Infection was associated with marked inflammatory infiltrates and multifocal epithelial necrosis of the nasal turbinate (FIG. 56A) and bronchiolar epithelium, resulting in degenerative neutrophils and cellular debris in the lumen (FIG. 56B). The endothelium of nearby vessels was reactive with adherence of mononuclear cells to the endothelium and transmigrating within vessel walls, indicative of endothelialitis (FIG. 56B). There was moderate to severe multifocal interstitial pneumonia characterized by pulmonary consolidation affecting 30-60% of the lung parenchyma as early as day 2 following SARS-CoV-2 infection (FIG. 56C). Inflammatory infiltrates consisted of massive numbers of macrophages and neutrophils with fewer lymphocytes. The nasal turbinate epithelium (FIG. 56D) and bronchiolar epithelial cells (FIG. 56E) were strongly positive for SARS nucleocapsid protein (SARS-CoV-N) by immunohistochemistry (NC) in regions of inflammation and necrosis. SARS-CoV-N IHC also showed locally extensive staining of the alveolar septa and interstitial mononuclear cells morphologically consistent with macrophages (FIG. 56F). Similarly, substantial SARS-CoV-2 viral RNA (vRNA) was observed in the bronchiolar epithelium and the pulmonary interstitium in regions of inflammation (FIG. 56G-H).

Figure 57A:
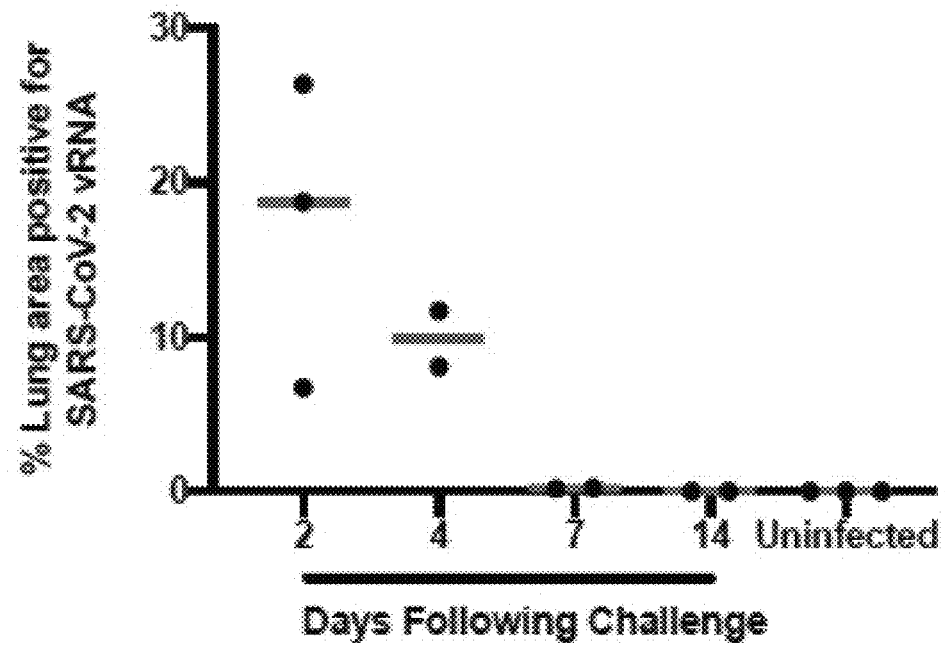
Figure 57B:
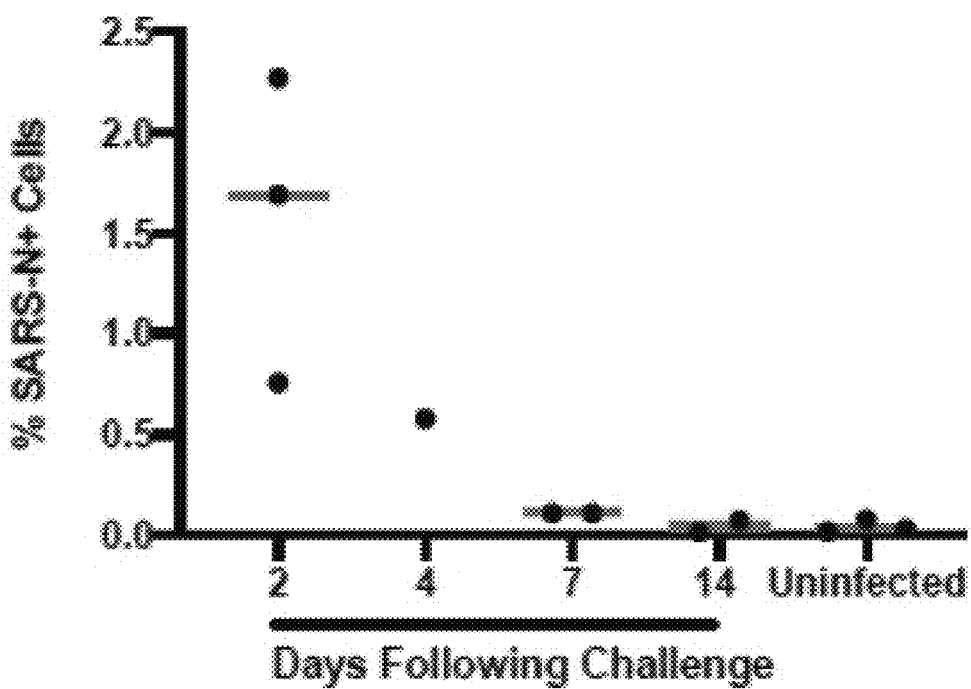
Figure 57C:
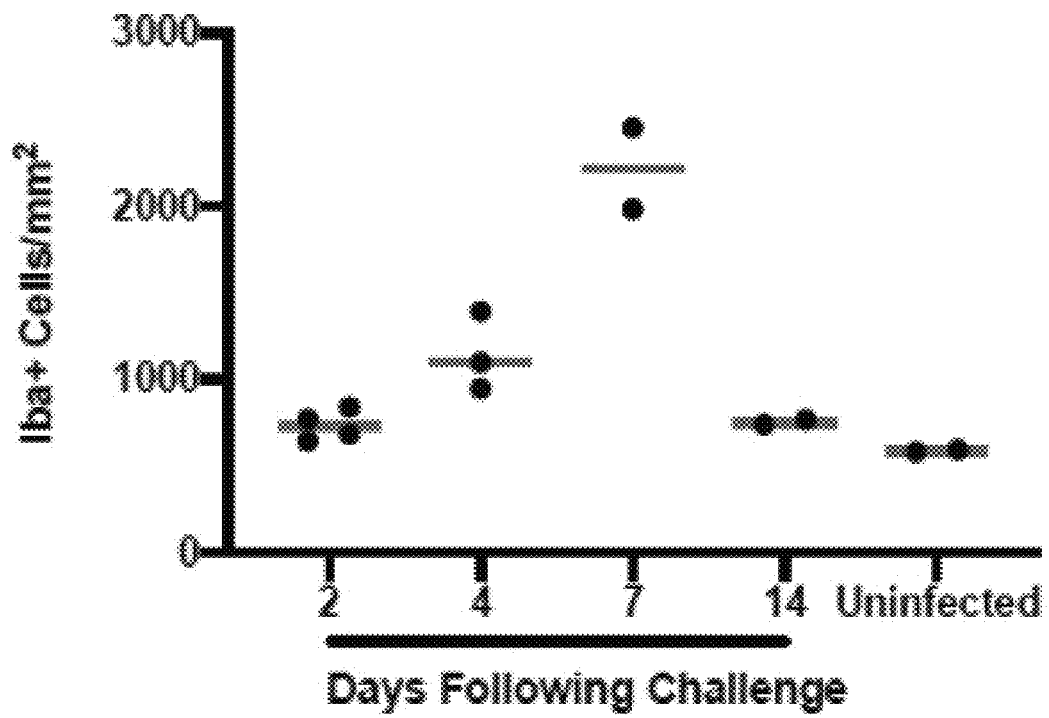
Figure 57D:
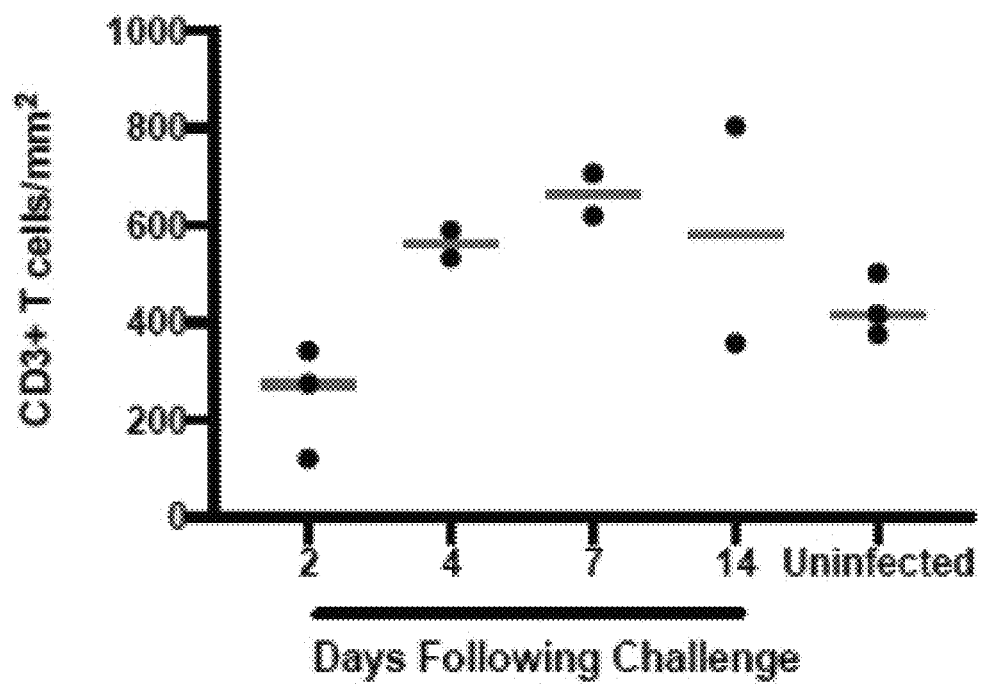
Figure 57E:
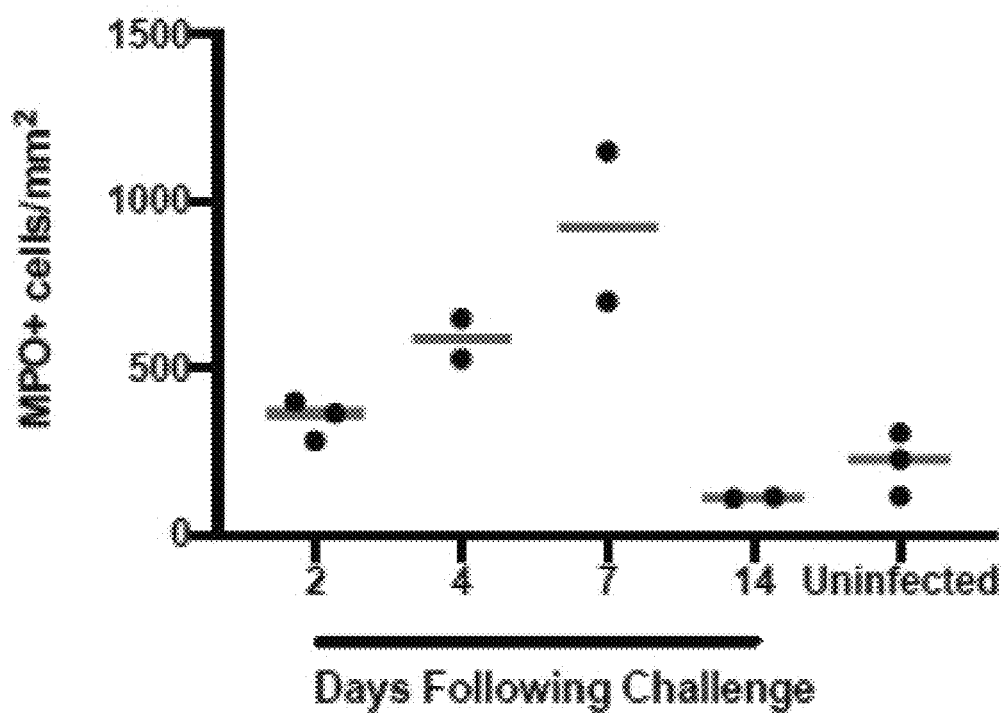
Figure 57F:
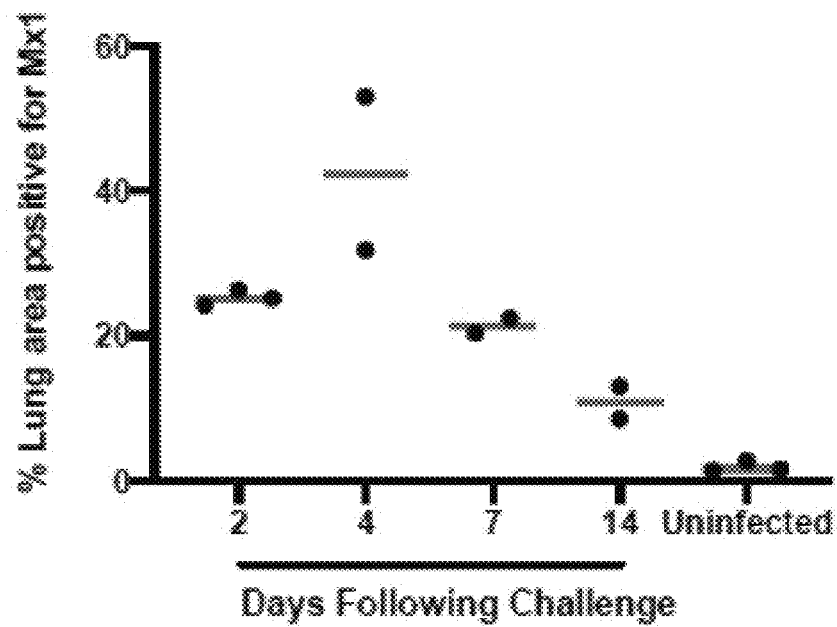

Levels of both SARS-CoV-2 vRNA and SARS-CoV-N protein expression in lung were highest on day 2 and diminished by day 4, with minimal vRNA and SARS-CoV-N protein detected by day 7 (FIGS. 57A-57B). The pneumonia was characterized by large inflammatory infiltrates of Iba-1+ macrophages in the lung interstitium as well as CD3+T lymphocytes (FIGS. 56I-56J). Numerous viable and degenerative neutrophils were detected throughout the lung, especially in regions of necrosis, with high expression of neutrophil myeloperoxidase (MPO) throughout the lung (FIG. 56K). Diffuse expression of the interferon inducible gene product, MX1, was also detected in the lung (FIG. 56L). In contrast with the kinetics of SARS-CoV-2 vRNA and SARS-CoV-N detection, which peaked on day 2, these markers of inflammation peaked on day 7 (FIGS. 57C-57F), coincident with maximal weight loss and mortality (FIGS. 55A-55B).

Detection of vRNA in the lung by RNASCOPE® did not simply reflect the viral inoculum, as not only negative anti-sense vRNA (FIGS. 58A-58E) was detected but also positive-sense vRNA (FIGS. 58F-58J), which overlapped in location and pattern, from day 2 to day 7 post challenge. SARS-CoV-2 vRNA expression (both anti-sense and sense) was present in lung with robust ACE2 receptor expression (FIGS. 58K-58O).

Figures 59A, 59B, 59C, 59D, 59E, 59F:
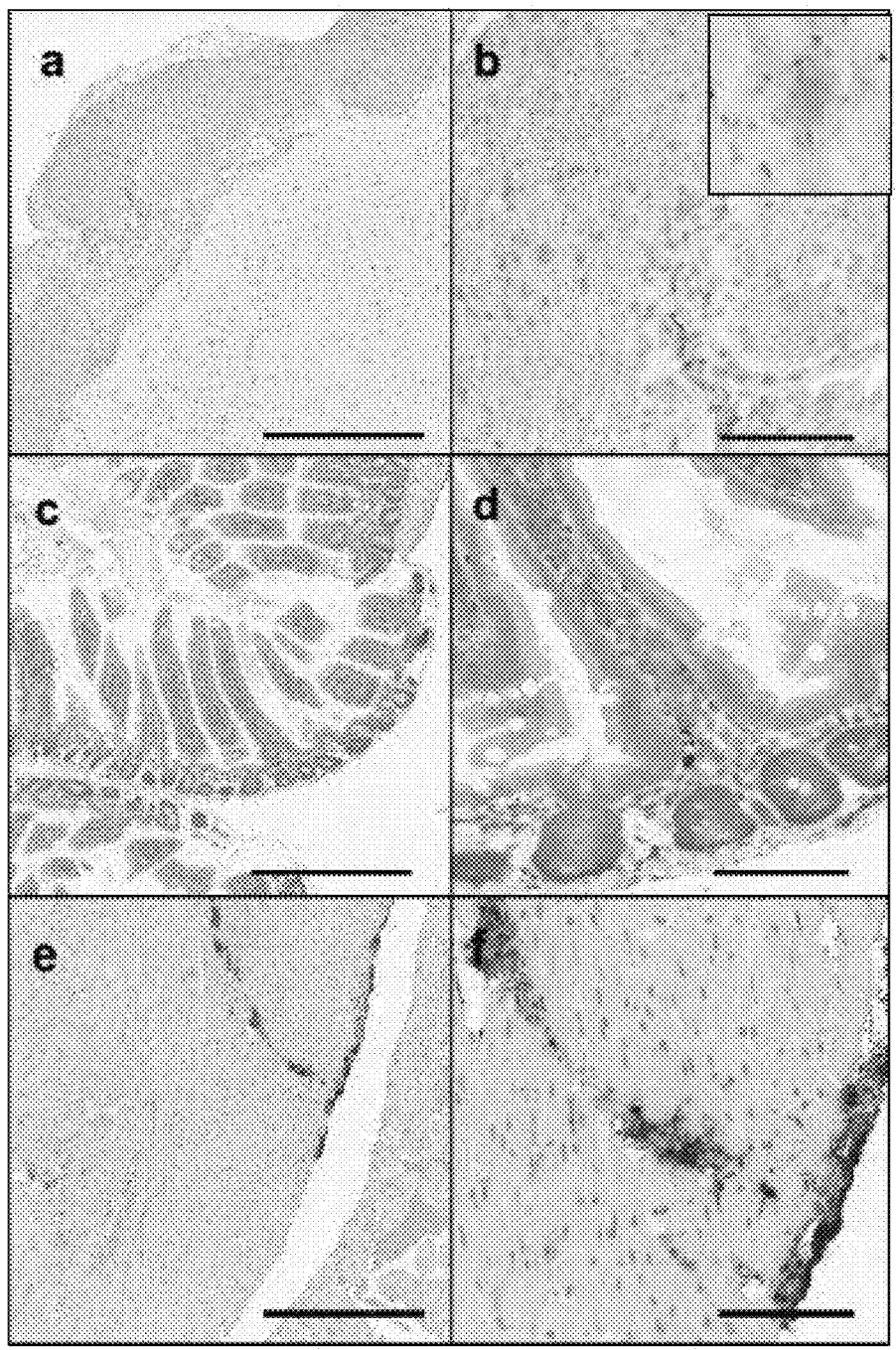
Figures 59G, 59H, 59I, 59J, 59K, 59L:
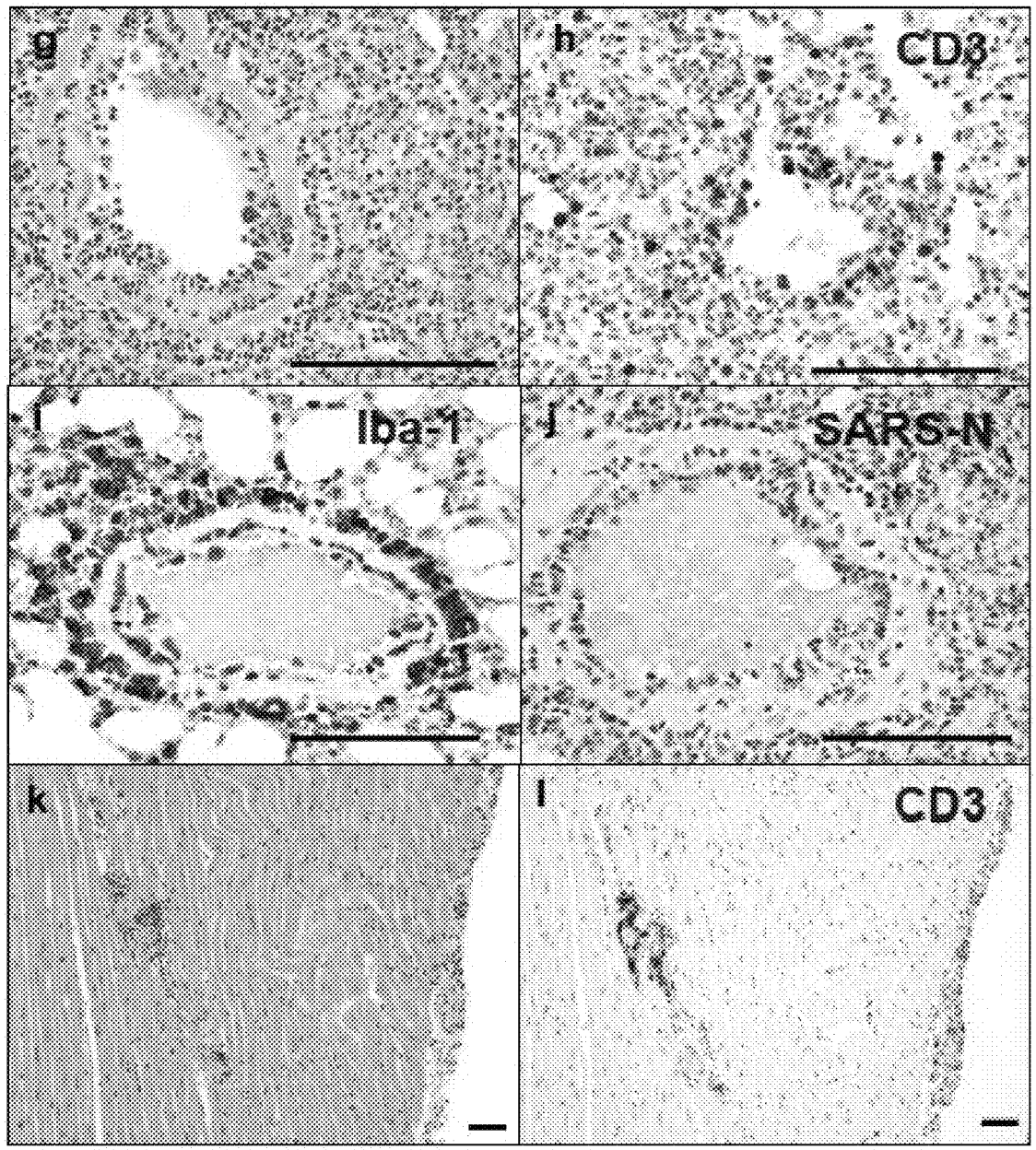
Figures 60A, 60B, 60C, 60D, 60E, 60F:
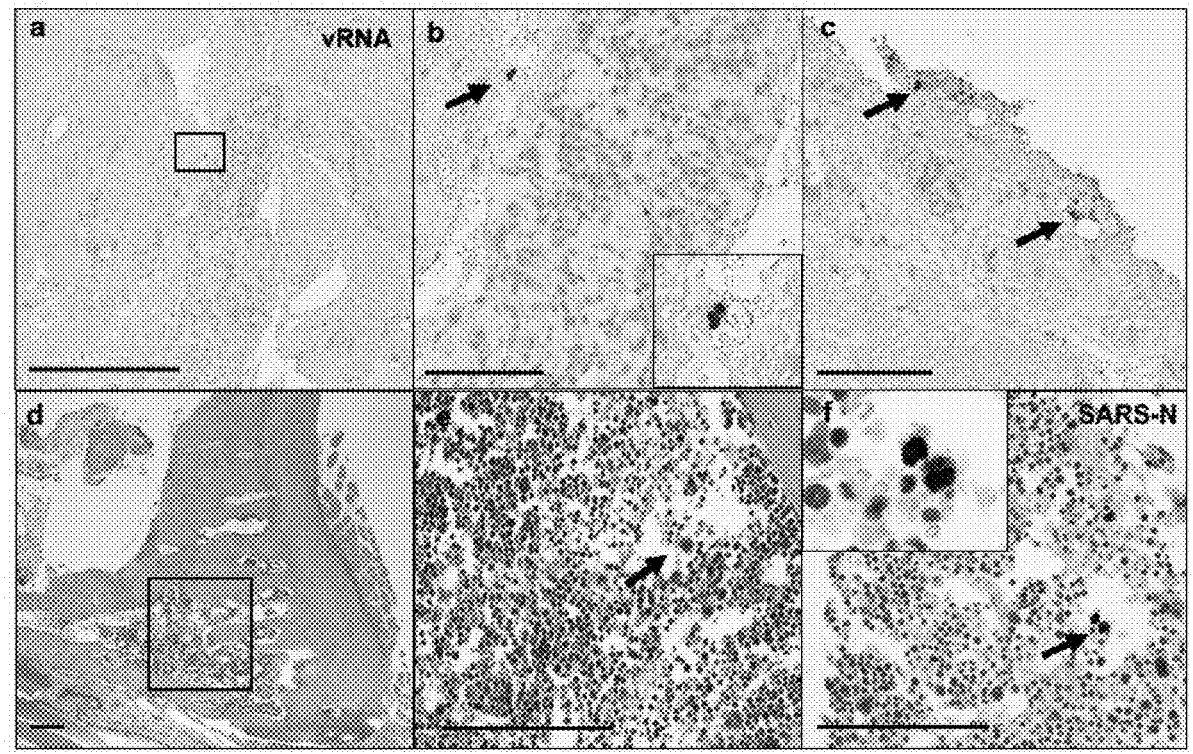

Systemic vRNA was also detected in distal tissues, including the brain stem, gastrointestinal tract, and myocardium (FIGS. 59A-59F). Prominent endothelialitis and perivascular inflammation with macrophages and lymphocytes was observed in these tissues, despite minimal SARS-CoV-N staining (FIGS. 59G-59J). Focal lymphocytic myocarditis was noted in one animal and corresponded to the presence of vRNA (FIGS. 59K-59L). Other sites of virus detection included peripheral blood mononuclear cells in thrombi in lung (FIGS. 60A-60C) and bone marrow of the nasal turbinate (FIGS. 60D-60F).

Figure 61A:
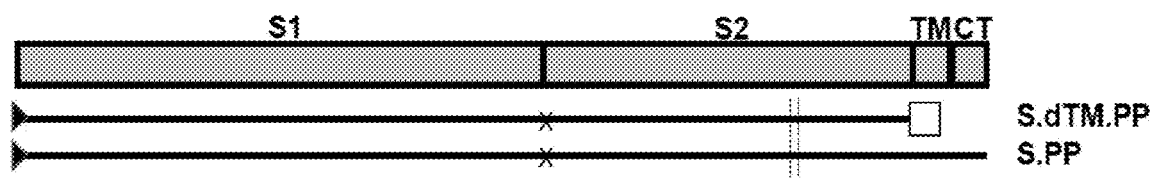
Figure 61B:
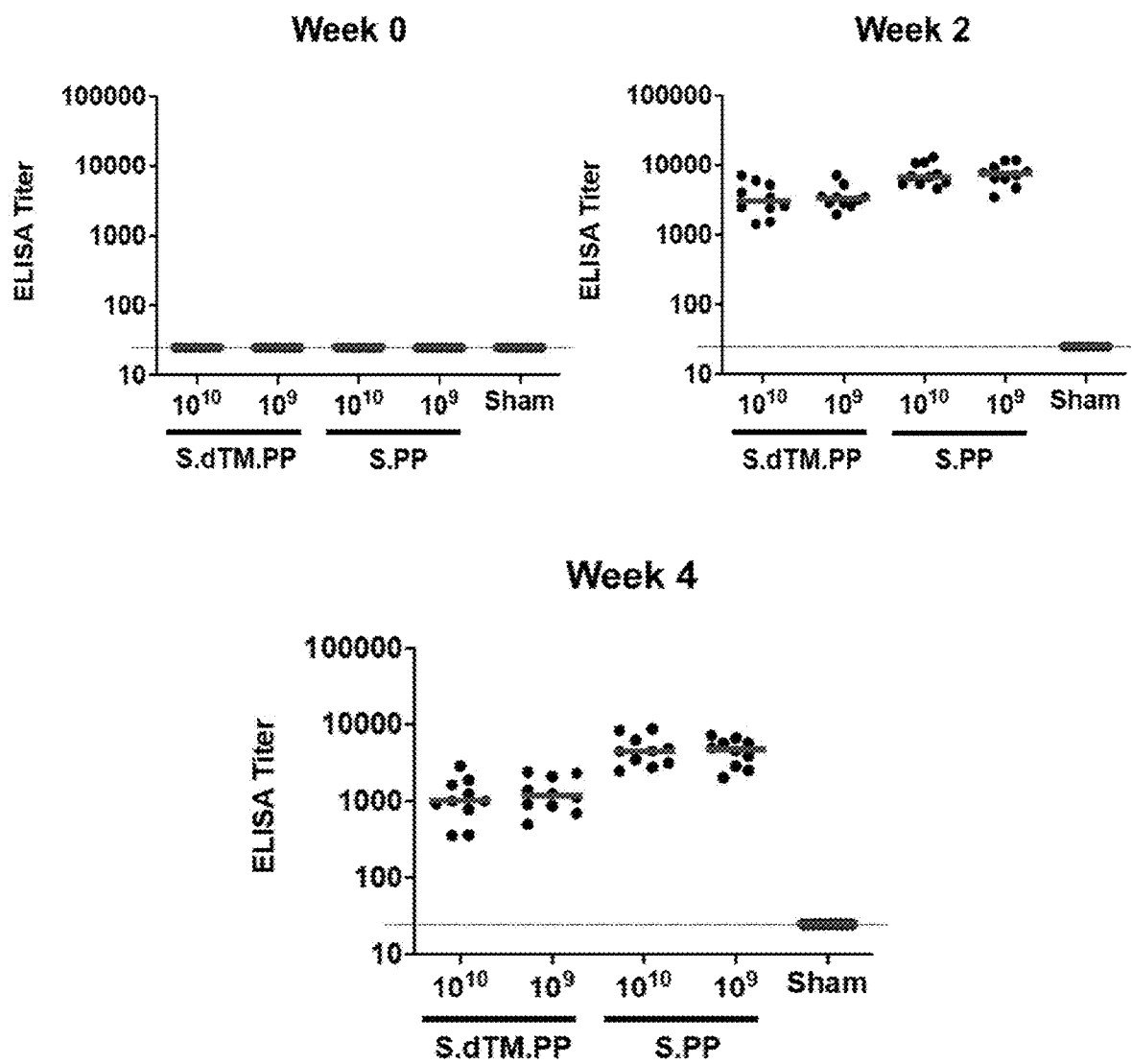
Figure 61C:
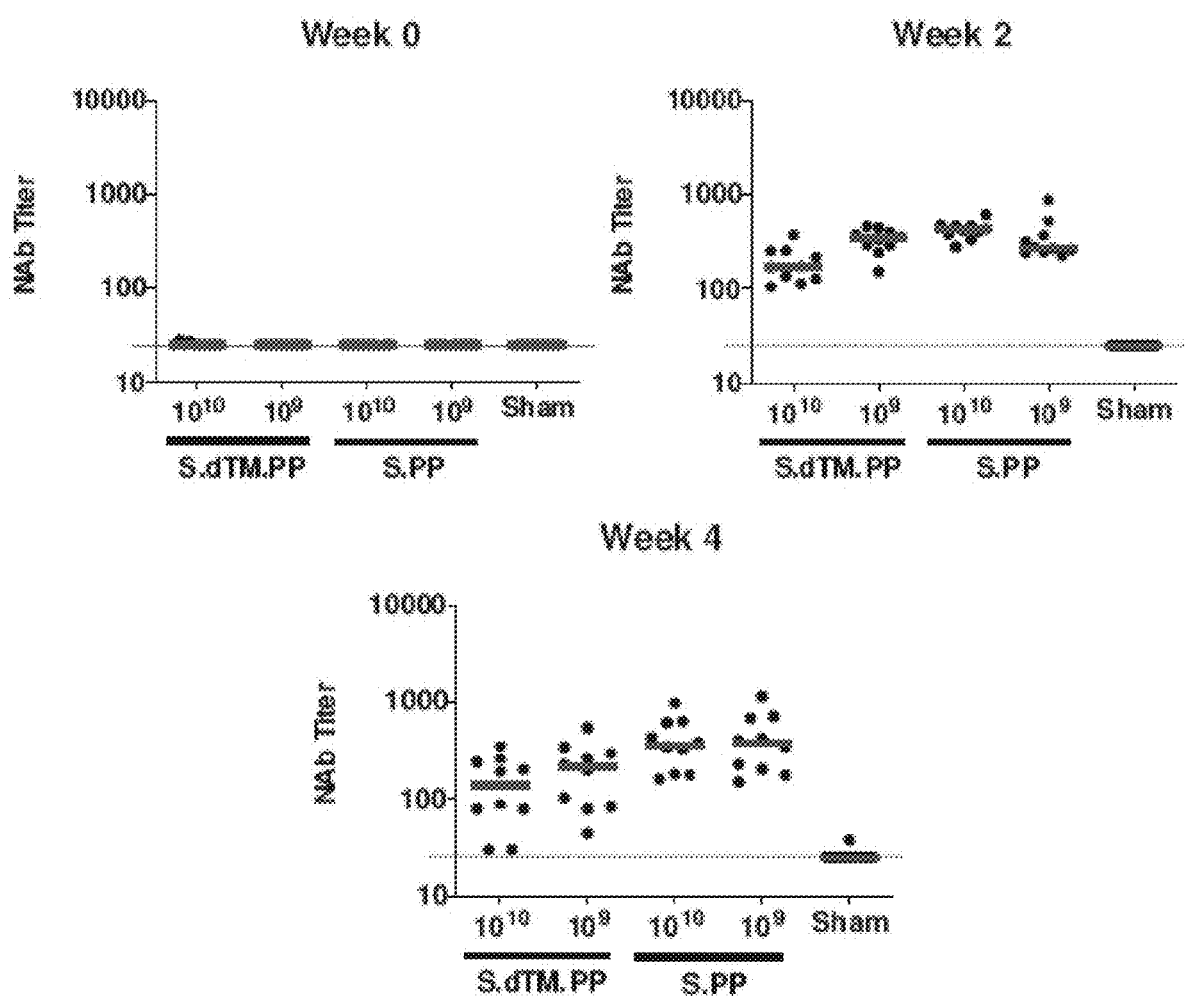

Recombinant, replication-incompetent Ad26 vectors were produced that encode (i) SARS-CoV-2 spike (S) with deletion of the transmembrane region and cytoplasmic tail reflecting the soluble ectodomain with a foldon trimerization domain (S.dTM.PP (SS-S.Ecto-dF-PP-foldon) or (ii) full-length S (S.PP (Ad26 SS-Spike-dF-PP)), both with mutation of the furin cleavage site and two proline stabilizing mutations[20] (FIG. 61A). The immunogenicity and protective efficacy of these vaccines against SARS-CoV-2 challenge in rhesus macaques were recently reported[13].

Figure 61D:
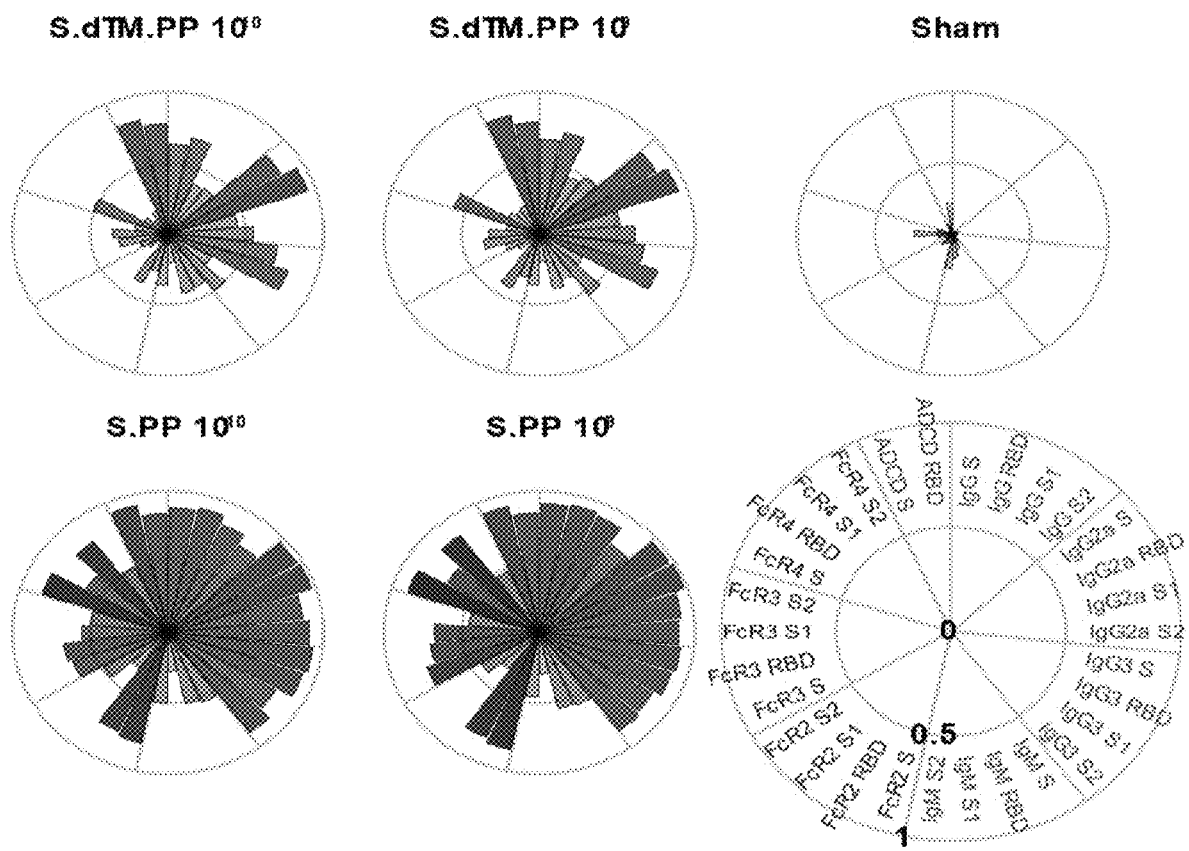
Figure 61E:
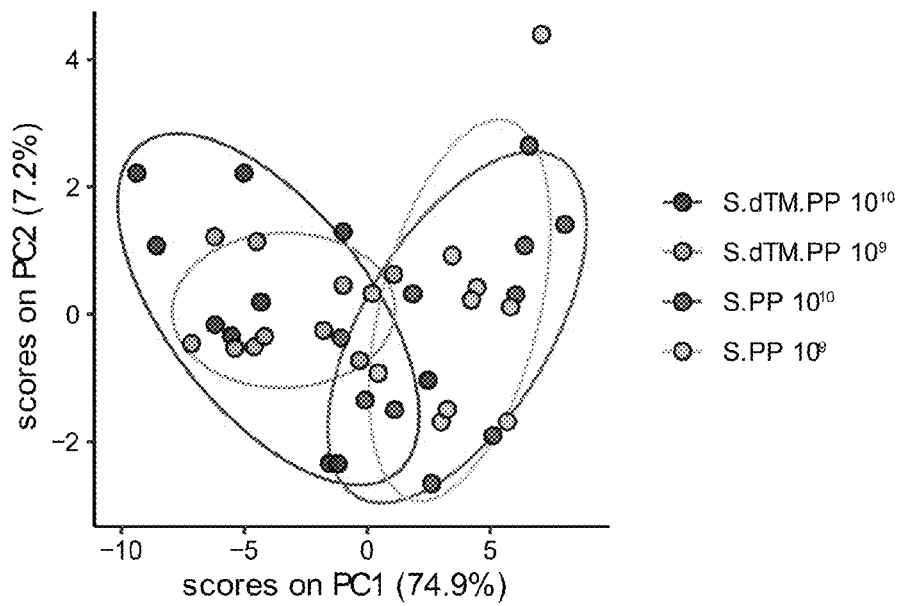
Figure 61F:
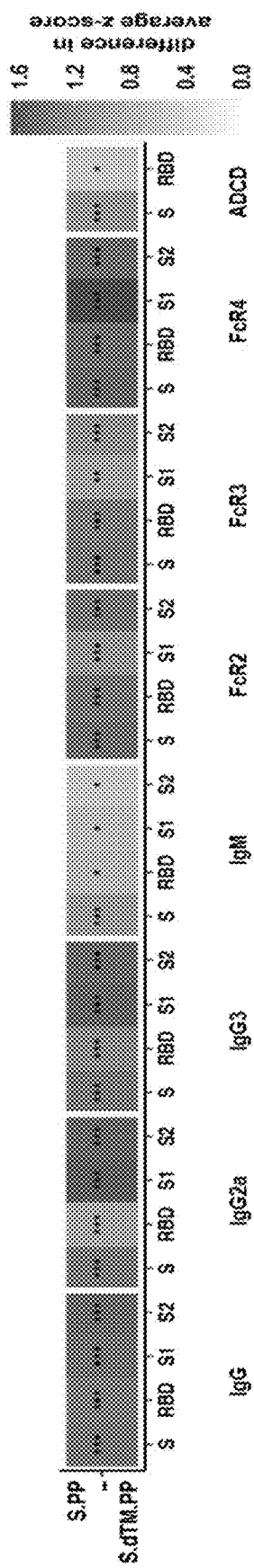

50 Syrian golden hamsters were immunized with $10^{10}$ or $10^9$ viral particles (vp) Ad26 vectors encoding S.dTM.PP or S.PP (N=10/group) or sham controls (N=10). Animals received a single vaccination by the intramuscular route at week 0. Receptor binding domain (RBD)-specific binding antibodies were observed by ELISA[10,11] (FIG. 61B) and neutralizing antibodies (NAbs) were observed by a pseudovirus neutralization assay[10,11,21] (FIG. 61C) in all animals at week 2 and week 4. At week 4, Ad26-S.PP elicited 4.0-4.7 fold higher median ELISA titers (4470, 4757) compared with Ad26-S.dTM.PP (Ad26 SS-S.Ecto-dF-PP-foldon) (1014, 1185) (FIG. 61B; P<0.0001, two-sided Mann-Whitney tests). Similarly, Ad26-S.PP elicited 1.8-2.6 fold higher median NAb IC50 titers (359, 375) compared with Ad26-S.dTM.PP (139, 211) (P<0.05, two-sided Mann-Whitney tests). For each vector, the two doses tested appeared comparable. ELISA and NAb data were correlated at both week 2 and week 4 (R=0.7074, P<0.0001 and R=0.7849, P<0.0001, respectively, two-sided Spearman rank-correlation tests; FIG. 62A). S-specific and RBD-specific antibody responses were characterized in the vaccinated animals at week 4 by systems serology[22]. IgG, IgG2a, IgG3, IgM, Fc-receptors FcRγ2, FcRγ3, and FcRγ4, and antibody-dependent complement deposition (ADCD) responses were assessed (FIGS. 61D-F). Higher and more consistent responses were observed with Ad26-S.PP compared with Ad26.S.dTM.PP (FIGS. 61D, 61F), and a principal component analysis of these antibody features confirmed that these two vaccines had distinct profiles (FIG. 61E).

Figure 63A:
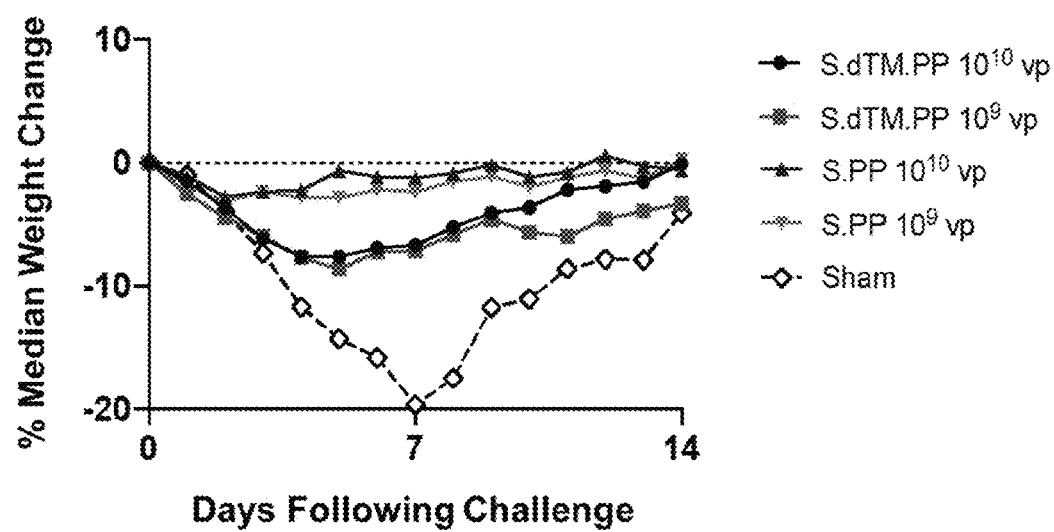
Figure 63B:
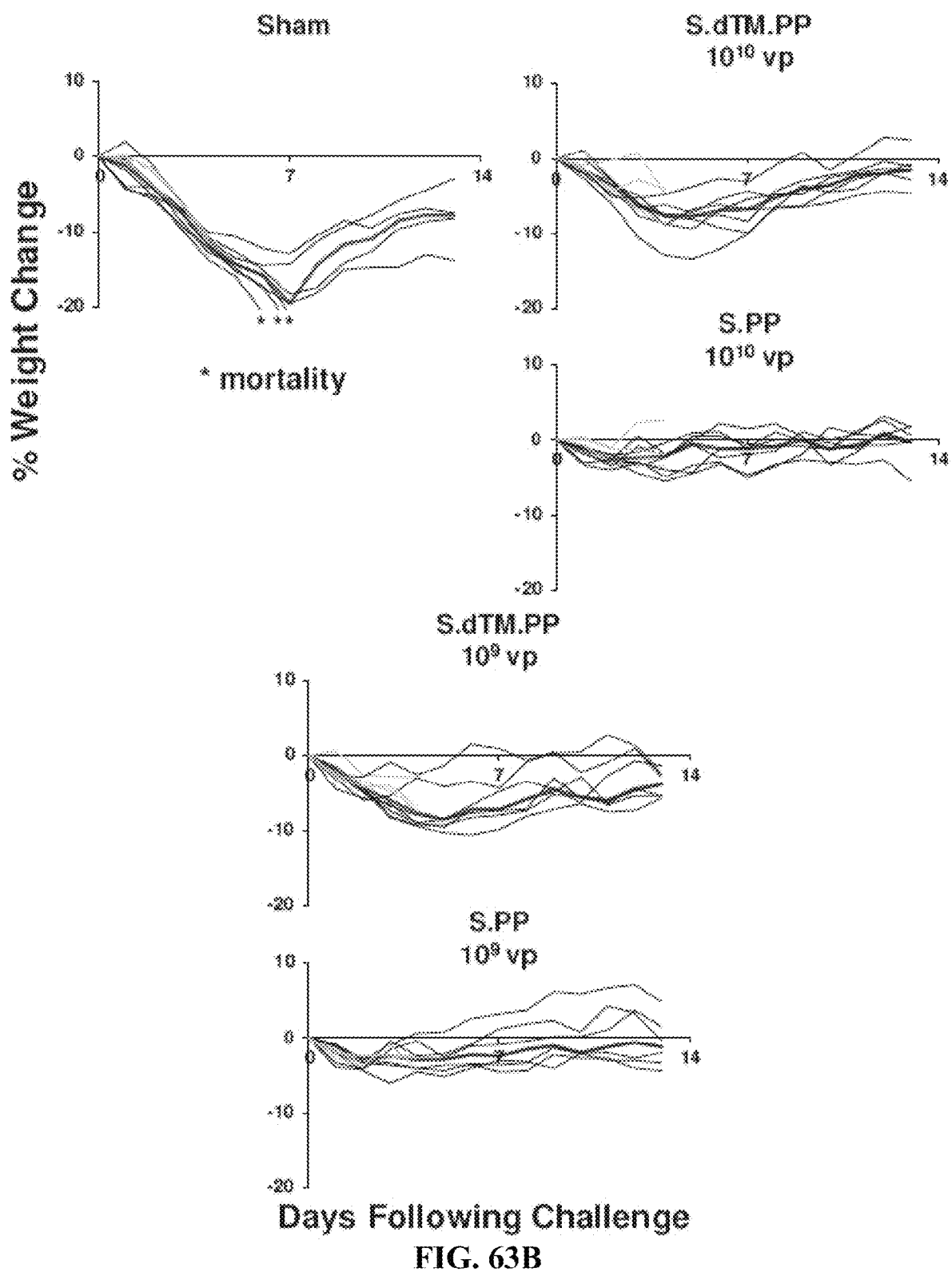
Figure 63C:
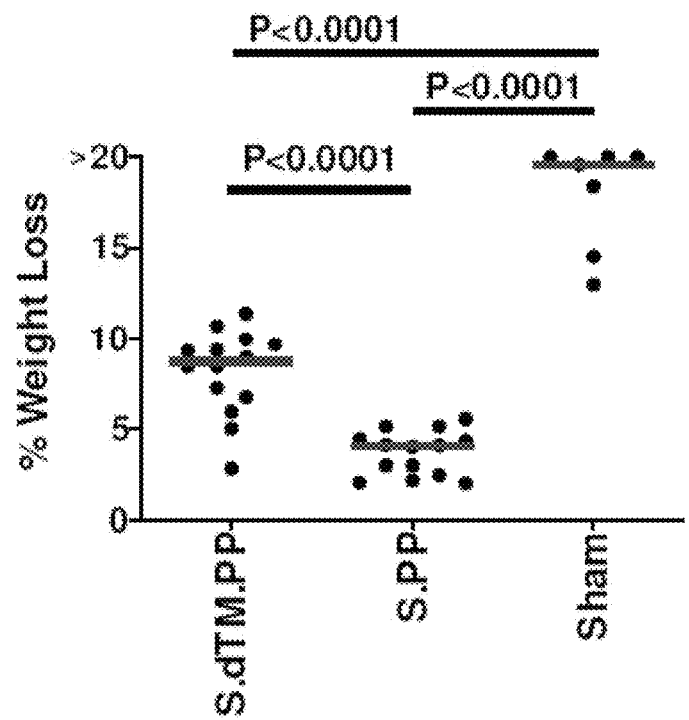

At week 4, all animals were challenged with $5 \times 10^5$ $TCID_{50}$ SARS-CoV-2 by the intranasal route. Three animals in each group were necropsied on day 4 for tissue viral loads and histopathology, and the remaining 7 animals in each group were followed until day 14. In the sham controls, hamsters lost a median of 19.6% of body weight by day 7, and 43% (3 of 7) of the animals that were followed longitudinally met euthanasia criteria on day 6-7 (FIGS. 63A-63B). The Ad26-S.dTM.PP vaccinated animals lost a median of 8.7% body weight, and the Ad26-S.PP vaccinated animals lost a median of 4.0% body weight (FIGS. 63A-63B). Maximum percent weight loss was markedly lower in both vaccinated groups compared with sham controls (P<0.0001, two-sided Mann-Whitney tests; FIG. 63C), and animals that received Ad26-S.PP showed less weight loss than animals that received Ad26.S.dTM.PP (P<0.0001, two-sided Mann-Whitney tests; FIG. 63C). Both vaccines protected against mortality, defined as meeting humane euthanization criteria, as compared with sham controls (P=0.02, two-sided Fisher's exact tests; FIG. 62B). A combined analysis of the two hamster experiments confirmed that both vaccines effectively protected against mortality (P=0.007, two-sided Fisher's exact tests; FIG. 62C). ELISA responses at week 2 (R=−0.8992, P<0.0001) and week 4 (R=−0.9344, P<0.0001) correlated inversely with maximum percent weight loss (FIG. 64A). NAb responses at week 2 (R=−0.7380, P<0.0001) and week 4 (R=−0.8075, P<0.0001) also correlated inversely with maximum percent weight loss (FIG. 64B).

Tissue viral loads were assessed in the subset of animals necropsied on day 4 and in the remaining surviving animals on day 14. On day 4 following high-dose SARS-CoV-2 challenge, virus was detected in tissues in all animals by subgenomic RNA RT-PCR, which is believed to measure replicating virus[10,23] (FIG. 65A). Median viral loads in lung tissue were approximately $10^{12}$ RNA copies/g in the sham controls compared with $10^8$ RNA copies/g in the Ad26-S.dTM.PP vaccinated animals and $10^8$ RNA copies/g in the Ad26-S.PP vaccinated animals. By day 14, virus was still detected in lung and nares of the surviving sham controls, but was observed in only a minority of Ad26-S.dTM.PP vaccinated animals and in none of the Ad26-S.PP vaccinated animals (FIG. 65B).

Figure 66A:
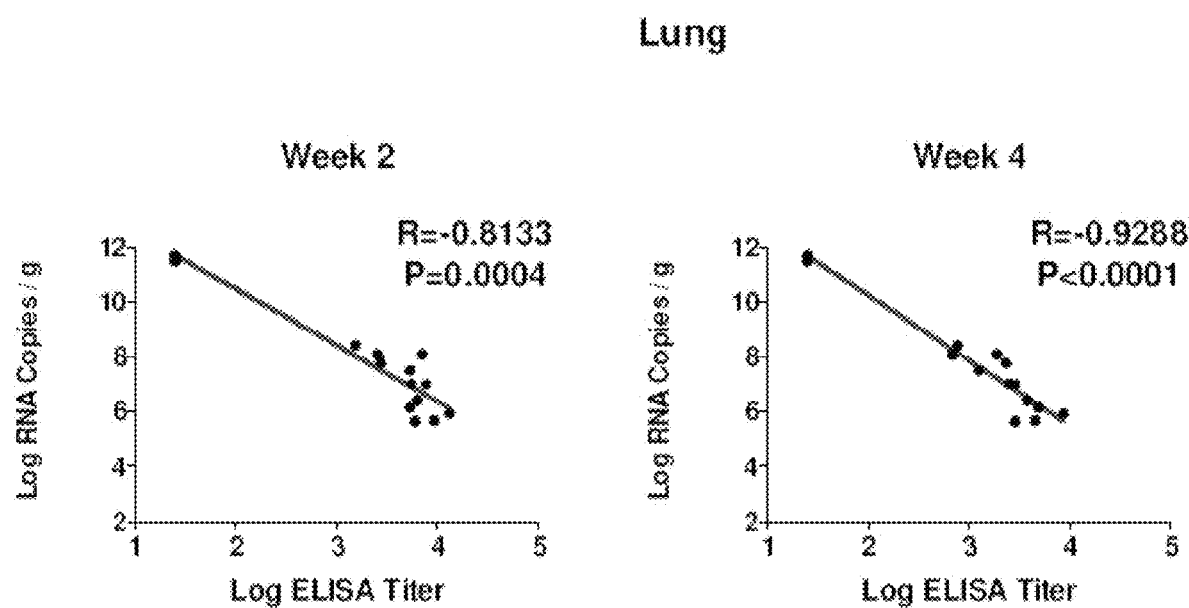
Figure 66B:
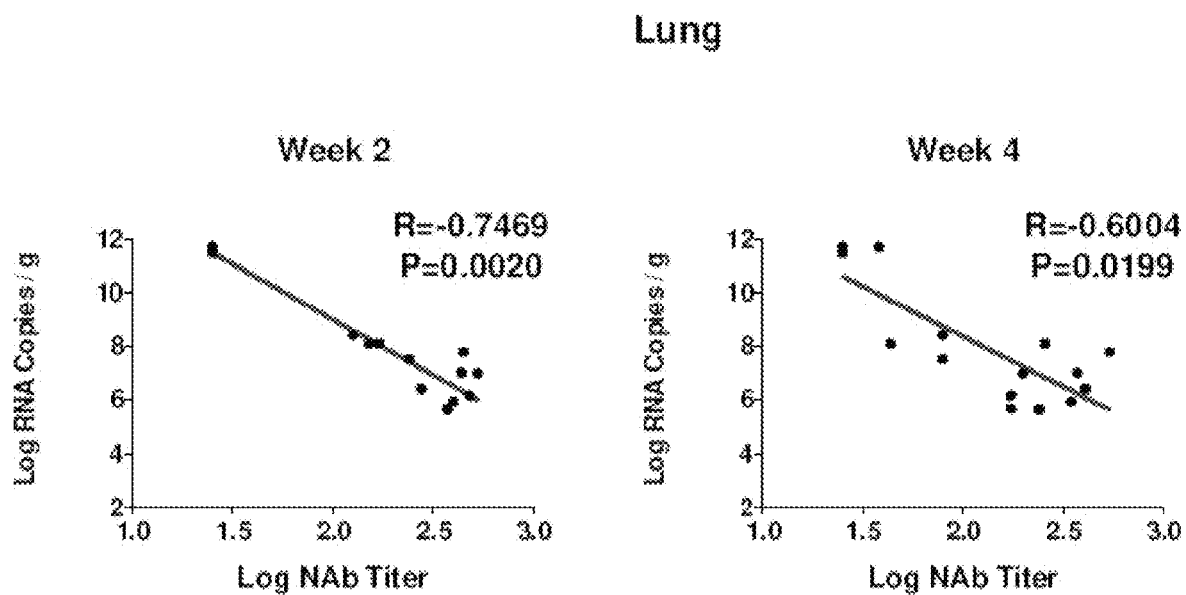
Figure 66C:
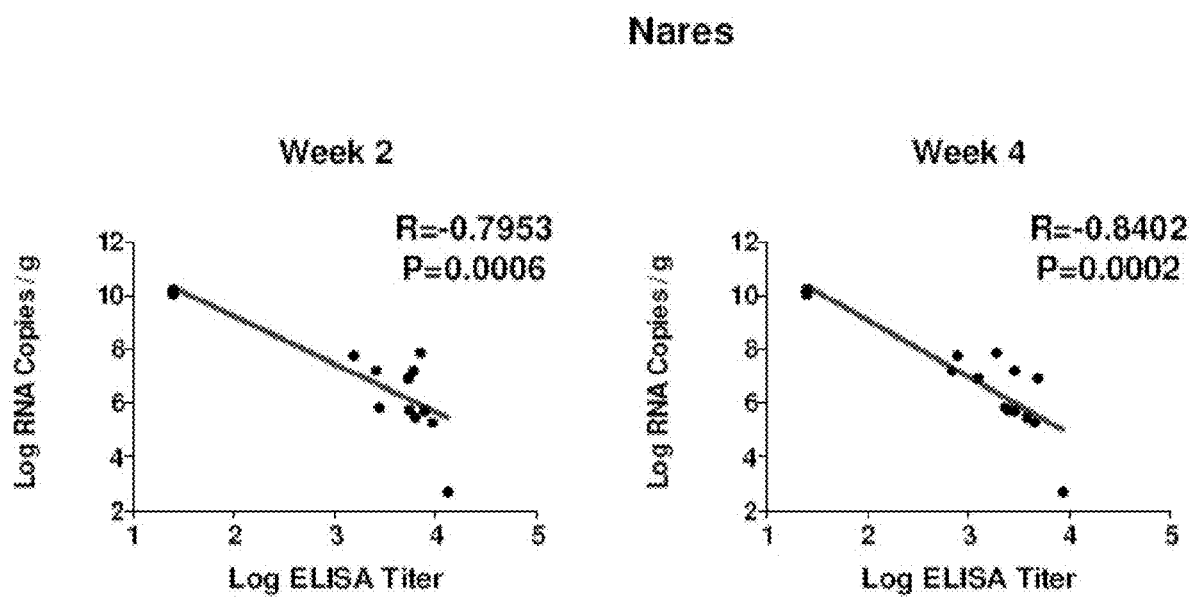
Figure 66D:
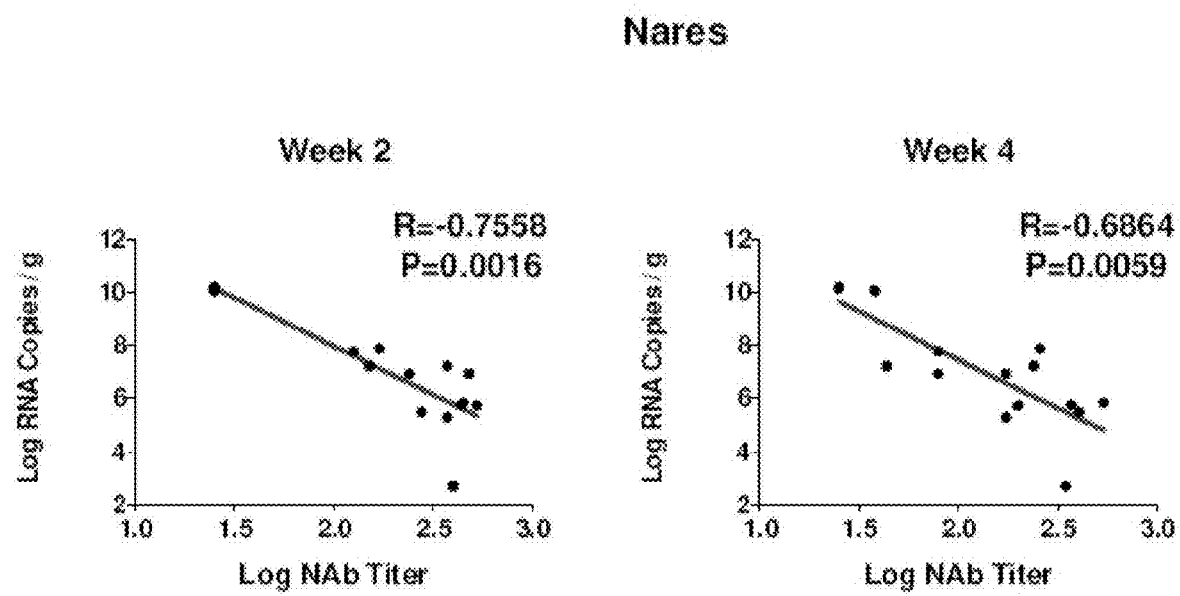

ELISA responses at week 2 (R=−0.8133, P=0.0004) and week 4 (R=−0.9288, P<0.0001) correlated inversely with lung viral loads at day 4 (FIG. 66A), and NAb responses at week 2 (R=−0.7469, P=0.0020) and week 4 (R=−0.6004, P=0.0199) correlated inversely with lung viral loads at day 4 (FIG. 66B). ELISA and NAb responses also correlated inversely with viral loads in nasal turbinates (FIGS. 66c, d). A deeper analysis of immune correlates revealed that multiple antibody characteristics correlated inversely with weight loss and tissue viral loads (FIG. 67A).

Figure 63D:
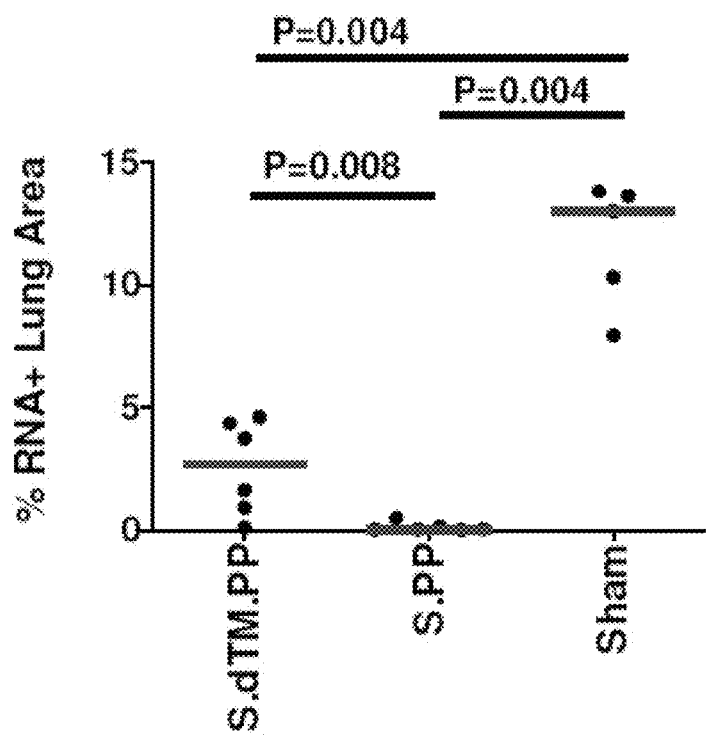

Vaccinated animals also demonstrated diminished pathology compared with sham controls on day 4 following challenge (FIG. 68). Ad26-S.PP vaccinated animals demonstrated minimal to no evidence of viral interstitial pneumonia, disruption of the bronchiolar epithelium, or peribronchiolar aggregates of CD3+T lymphocytes and macrophages. Histiocytic and neutrophilic inflammatory infiltrates were markedly reduced in all lung lobes with significantly reduced SARS-CoV-2 vRNA in Ad26-S.dTM.PP and Ad26-S.PP vaccinated hamsters compared with sham controls (P=0.004 and P=0.004, respectively, two-sided Mann-Whitney tests; FIG. 63D).

The surviving sham controls developed potent binding and neutralizing antibody responses by day 14 following challenge (FIG. 67B). Vaccinated animals also demonstrated higher ELISA and NAb responses following challenge (FIG. 67B), consistent with tissue viral loads showing low and transient levels of virus replication in these animals following high-dose SARS-CoV-2 challenge.

In this study, a single immunization of an Ad26 vector encoding a full-length prefusion stabilized S immunogen (S.PP) was demonstrated to protect against severe clinical disease following high-dose SARS-CoV-2 challenge in hamsters. Sham controls demonstrated marked weight loss, severe pneumonia, and partial mortality. In contrast, vaccinated animals showed minimal weight loss and pneumonia and no mortality. Vaccine-elicited binding and neutralizing antibody responses correlated with protection against clinical disease as well as reduced virus replication in the upper and lower respiratory tract.

This severity of clinical disease in this model contrasts with prior studies involving SARS-CoV-2 infection in hamsters[5-7] and other species[8-10,14-18]. Hamsters are a permissive model for SARS-CoV-2 as a result of their homology to the human ACE2 receptor[5], and transmission among hamsters has been reported[6]. The high challenge dose resulted in extensive clinical disease in the present study, although biologic factors that may influence the extent of clinical disease, such as animal age, animal origin, and challenge stock, remain to be studied rigorously. SARS-CoV-2 vaccine studies in nonhuman primates have to date demonstrated protection against infection or reduction of viral replication in the upper and lower respiratory tracts[11,12]. A single immunization of Ad26-S.PP was recently reported to provide complete or near-complete protection against SARS-CoV-2 challenge in rhesus macaques[13]. However, SARS-CoV-2 infection in nonhuman primates does not result in severe clinical disease or mortality[8-10]. A severe disease model would be useful to complement current nonhuman primate challenge models, since protection against viral replication does not necessarily imply protection against severe disease. Indeed, in the histopathologic analysis of hamsters in the present study, viral loads in lung decreased from day 2 to day 7, whereas inflammatory markers continued to escalate during this time period and correlated with continued weight loss. These data suggest that progressive clinical disease in hamsters is primarily an inflammatory process, which is triggered by infection but continued to increase even when viral replication decreased. Because COVID-19 in humans can progress to severe clinical disease, it is important to test SARS-CoV-2 vaccine candidates in preclinical models that recapitulate severe clinical disease, including fulminant pneumonia and mortality. The high-dose hamster model described herein achieves many of these criteria and therefore represents a useful model for human disease and treatment, in particular with regard to the pathogenesis of severe disease. The primary manifestation of clinical disease in this model was severe pneumonia, rather than encephalitis that has been reported in certain hACE2 transgenic mouse models[24]. Moreover, binding and neutralizing antibody responses correlated with protection.

In summary, these data demonstrate that a single immunization of Ad26-S.PP provides robust protection against severe clinical disease following high-dose SARS-CoV-2 infection in an animal model that closely resembles disease development and progression in humans. Such vaccine protection against severe SARS-CoV-2 pneumonia and mortality has not previously been reported. Ad26-S.PP, which is also termed Ad26.COV2.S, is currently being evaluated in clinical trials. This hamster severe disease model can also be used for testing of SARS-CoV-2 vaccines, therapeutics, and other countermeasures.

REFERENCES

1 Li, Q. et al. Early Transmission Dynamics in Wuhan, China, of Novel Coronavirus-Infected Pneumonia. *N Engl J Med*, doi:10.1056/NEJMoa2001316 (2020).

2 Zhu, N. et al. A Novel Coronavirus from Patients with Pneumonia in China, 2019. *N Engl J Med* 382, 727-733, doi:10.1056/NEJMoa2001017 (2020).
3 Chen, N. et al. Epidemiological and clinical characteristics of 99 cases of 2019 novel coronavirus pneumonia in Wuhan, China: a descriptive study. *Lancet* 395, 507-513, doi:10.1016/S0140-6736(20)30211-7 (2020).
4 Huang, C. et al. Clinical features of patients infected with 2019 novel coronavirus in Wuhan, China. *Lancet* 395, 497-506, doi:10.1016/50140-6736(20)30183-5 (2020).
5 Chan, J. F. et al. Simulation of the clinical and pathological manifestations of Coronavirus Disease 2019 (COVID-19) in golden Syrian hamster model: implications for disease pathogenesis and transmissibility. *Clin Infect Dis*, doi: 10.1093/cid/ciaa325 (2020).
6 Sia, S. F. et al. Pathogenesis and transmission of SARS-CoV-2 in golden hamsters. *Nature*, doi:10.1038/s41586-020-2342-5 (2020).
7 Imai, M. et al. Syrian hamsters as a small animal model for SARS-CoV-2 infection and countermeasure development. *Proc Natl Acad Sci USA* 117, 16587-16595, doi: 10.1073/pnas.2009799117 (2020).
8 Munster, V. J. et al. Respiratory disease in rhesus macaques inoculated with SARS-CoV-2. *Nature*, doi: 10.1038/s41586-020-2324-7 (2020).
9 Rockx, B. et al. Comparative pathogenesis of COVID-19, MERS, and SARS in a nonhuman primate model. *Science*, doi:10.1126/science.abb7314 (2020).
10 Chandrashekar, A. et al. SARS-CoV-2 infection protects against rechallenge in rhesus macaques. *Science*, doi: 10.1126/science.abc4776 (2020).
11 Yu, J. et al. DNA vaccine protection against SARS-CoV-2 in rhesus macaques. *Science*, doi:10.1126/science-.abc6284 (2020).
12 Gao, Q. et al. Rapid development of an inactivated vaccine candidate for SARS-CoV-2. *Science*, doi: 10.1126/science.abc1932 (2020).
13 Mercado, N. B. et al. Single-shot Ad26 vaccine protects against SARS-CoV-2 in rhesus macaques. *Nature*, doi: 10.1038/s41586-020-2607-z (2020).
14 Blanco-Melo, D. et al. Imbalanced Host Response to SARS-CoV-2 Drives Development of COVID-19. *Cell* 181, 1036-1045 e1039, doi:10.1016/j.cell.2020.04.026 (2020).
15 Kim, Y. I. et al. Infection and Rapid Transmission of SARS-CoV-2 in Ferrets. *Cell Host Microbe* 27, 704-709 e702, doi:10.1016/j.chom.2020.03.023 (2020).
16 Shi, J. et al. Susceptibility of ferrets, cats, dogs, and other domesticated animals to SARS-coronavirus 2. *Science* 368, 1016-1020, doi:10.1126/science.abb7015 (2020).
17 Bao, L. et al. The pathogenicity of SARS-CoV-2 in hACE2 transgenic mice. *Nature*, doi:10.1038/s41586-020-2312-y (2020).
18 Sun, S. H. et al. A Mouse Model of SARS-CoV-2 Infection and Pathogenesis. *Cell Host Microbe* 28, 124-133 e124, doi:10.1016/j.chom.2020.05.020 (2020).
19 Abbink, P. et al. Comparative seroprevalence and immunogenicity of six rare serotype recombinant adenovirus vaccine vectors from subgroups B and D. *J Virol* 81, 4654-4663, doi:JVI.02696-06 [pii] 10.1128/JVI.02696-06 (2007).
20 Wrapp, D. et al. Cryo-EM structure of the 2019-nCoV spike in the prefusion conformation. *Science* 367, 1260-1263, doi:10.1126/science.abb2507 (2020).
21 Yang, Z. Y. et al. A DNA vaccine induces SARS coronavirus neutralization and protective immunity in mice. *Nature* 428, 561-564, doi:10.1038/nature02463 (2004).
22 Chung, A. W. et al. Dissecting Polyclonal Vaccine-Induced Humoral Immunity against HIV Using Systems Serology. *Cell* 163, 988-998, doi:10.1016/j.cell.2015.10.027 (2015).
23 Wolfel, R. et al. Virological assessment of hospitalized patients with COVID-2019. *Nature*, doi:10.1038/s41586-020-2196-x (2020).
24 Netland, J., Meyerholz, D. K., Moore, S., Cassell, M. & Perlman, S. Severe acute respiratory syndrome coronavirus infection causes neuronal death in the absence of encephalitis in mice transgenic for human ACE2. *J Virol* 82, 7264-7275, doi:10.1128/JVI.00737-08 (2008).
25 Brown, E. P. et al. High-throughput, multiplexed IgG subclassing of antigen-specific antibodies from clinical samples. *J Immunol Methods* 386, 117-123, doi:10.1016/j.jim.2012.09.007 (2012).
26 Fischinger, S. et al. A high-throughput, bead-based, antigen-specific assay to assess the ability of antibodies to induce complement activation. *J Immunol Methods* 473, 112630, doi:10.1016/j.jim.2019.07.002 (2019).

Example 13. Antigen Designs

Several antigens based on the sequence of the full-length Wuhan-CoV S protein were designed, a few of which are schematically shown in FIG. 69. All sequences were based on the SARS-CoV-2 Spike full-length protein (YP_009724390.1—SEQ ID NO: 29).

For the different antigens, different signal peptide/leader sequences were used, such as the natural wild-type signal peptide in COR200006, 200007 and 200008), a tPA signal peptide (COR200009, 200010 and 200011) or a chimeric leader sequence (COR200018).

In addition, some of the constructs contained the wild type Furin cleavage site (wt), (i.e., 200006, 200009 and 200018) and in some constructs (i.e., 200007, 200008, 200010 and 200011) the furin cleavage site was removed by changing the Furin site amino acid sequence RRAR (wt) (SEQ ID NO: 90 and 224) to SRAG (dFur) (SEQ ID NO: 225), i.e., by introducing a R682S and a R685G mutation (wherein the numbering of the amino acid positions is according to the numbering in the amino acid sequence YP_009724390—SEQ ID NO: 29) to optimize stability and expression.

In some of the constructs, stabilizing (proline) mutations in the hinge loop at positions 986 and 987 were introduced to optimize stability and expression, in particular, COR20007, 20008, 200010 and 200011 comprise the K986P and V987P mutations (wherein the numbering of the amino acid positions is according to the numbering in the amino acid sequence YP_009724390—SEQ ID NO: 29).

Finally, in constructs 200008 and 200011, the ER retention signal was deleted to optimize trafficking and expression, i.e., by removing the last 5 amino acids KLHYT (SEQ ID NO: 226). Expression and antigenicity of several SARS-CoV-2 immunogen designs, including COR200010, 200011 and 200018 were tested in Cell-based Elisa (CBE) and fluorescence activated cell sorting (FACS) experiments.

For the CBE, HEK293 cells were seeded to 100% confluency on black-walled Poly-D-lysine coated microplates on day 1. The cells were transfected with plasmids using lipofectamine on day 2, and the cell-based ELISA was performed on day 4 at 4° C. No fixation step was used. BM Chemiluminescence ELISA substrate (Roche) was used to detect secondary antibody. The Ensight machine was used to measure the cell confluencies and luminescence intensities. Several SARS-CoV antibodies that cross-react with SARS-CoV-2 S protein were used. The antibody CR3022 (disclosed in WO06/051091) is known to be neutralizing SARS-CoV with low potency (Ter Meulen et al. (2006), PLOS Medicine). It does not neutralize SARS-CoV-2. It binds only when at least two receptor binding regions (RBDs) are in the up position (Yuan et al., Science. 2020 Apr. 3. pii: eabb7269. doi: 10.1126/science.abb7269. [Epub ahead of print]; Joyce et al. doi: https://doi.org/10.1101/2020.03.15.992883). CR3015 (disclosed in WO2005/012360) is known to be non-neutralizing SARS-CoV. CR3023, CR3046, CR3050, CR3054 and CR3055 are also considered to be non-neutralizing antibodies. The results are shown in FIG. 70.

Figure 71:
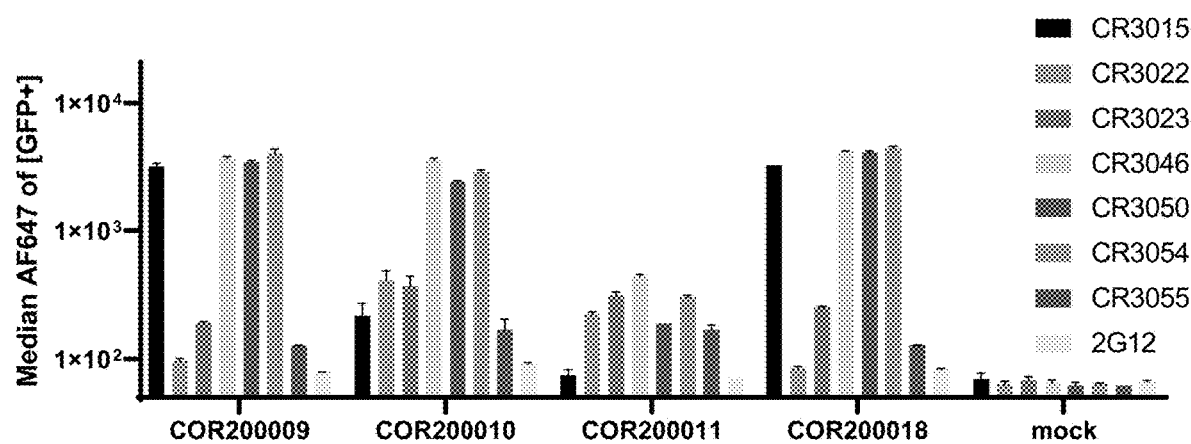

As shown, COR200010 had the highest neutralizing:non-neutralizing Ab binding ratio, which reflects favorable antigenicity and correct native folding of the S protein and thus may indicate that the protein is predominantly in the pre-fusion-like state. Based on these data and the FACS data (see FIG. 71) COR200011 was deselected and not tested further. In addition, COR200008 was deselected (data not shown).

In addition, 6-8 week old Balb/C mice were intramuscularly immunized with 100 mcg of the respective DNA construct or phosphate buffered saline as control. Serum SARS-CoV-2 Spike-specific antibody titers were determined on day 19 after immunization by ELISA using a recombinant soluble stabilized Spike target antigen. The inserts were the membrane anchored versions COR20007, COR20008, COR20009, COR200010, COR200011 and COR200018.

Cloning of SARS-CoV2 Spike protein consists out of 2 distinct steps:

1: Design and Cloning of SARS-CoV2 Spike Protein into a Shuttle Expression Vector This vector comprises a human Cytomegalovirus (hCMV) promoter that carries two tetracycline operator (tetO) sequences within the hCMV promoter and a SV40 polyAdenylation signal. The expression vector is used for in vitro and in vivo experiments and for the generation of an Ad26-virus carrying the SARS-CoV2 Spike protein.

2: Cloning of the Expression Vector into the Ad26 Virus

Design and cloning of SARS-CoV2 Spike protein designs into a shuttle expression vector As described in Example 13, based on wt SARS-CoV2 Spike protein (ref, YP_009724390—SEQ ID NO: 29) several constructs based on full length SARS-CoV-spike protein were designed (named COR20007, COR20008, COR 20009, COR 200010, COR200011 and COR200018), wherein different signal peptide's, Furin cleavage site removal, stabilizing mutations and variations in the transmembrane region were introduced (see table)

| | | Description/modification | | | | SEQ ID NO | |
|---|---|---|---|---|---|---|---|
| Plasmid name | Insert name | Signal peptide | Furine cleavage | Stabilization | Trans membrane | Protein | DNA* |
| pUC_CMVde1134TO_COR20007 | COR20007 | wt | dFur | PP | Wt | 205 | 211 |
| pUC_CMVde1134TO_COR20008 | COR20008 | wt | dFur | PP | dERRS | 206 | 212 |
| pUC_CMVde1134TO_COR20009 | COR20009 | tPA | wt | wt | Wt | 207 | 213 |
| pUC_CMVde1134TO_COR200010 | COR200010 | tPA | dFur | PP | Wt | 208 | 214 |
| pUC_CMVde1134TO_COR200011 | COR200011 | tPA | dFur | PP | dERRS | 209 | 215 |
| pUC_CMVde1134TO_COR200018 | COR200018 | tPA + wt | wt | wt | Wt | 210 | 216 |

*Note:
nt sequences encode the coding sequences only; i.e. do not include the additionally added 5'- and 3'- sequences which are described below.

Figure 72:
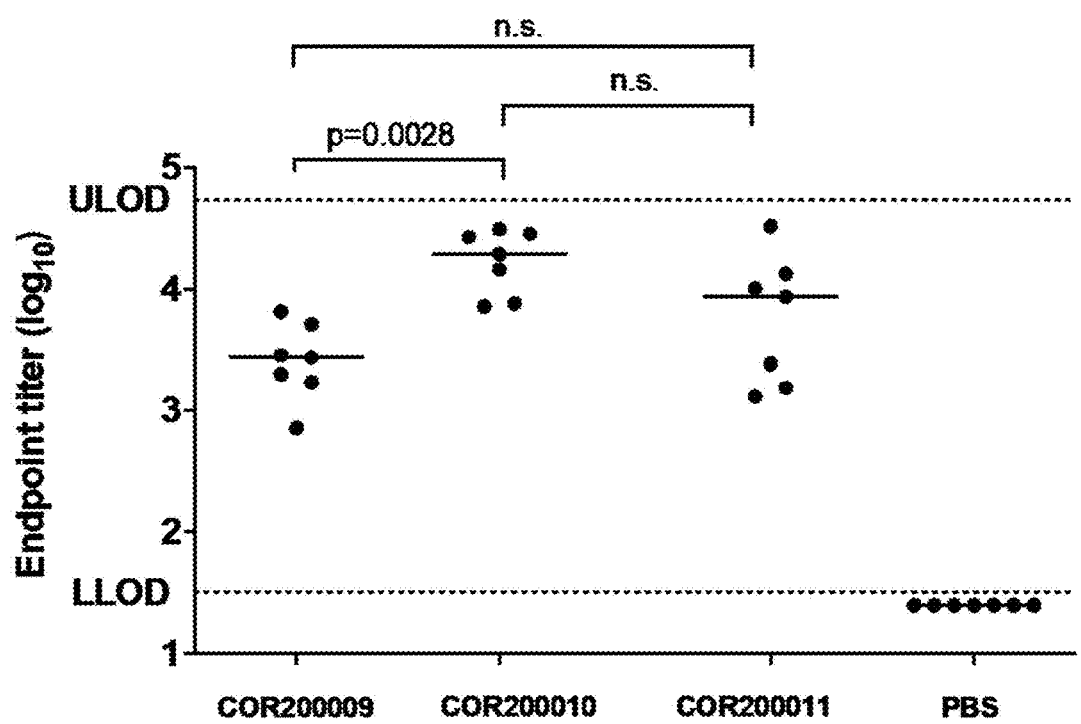
Figure 76A:
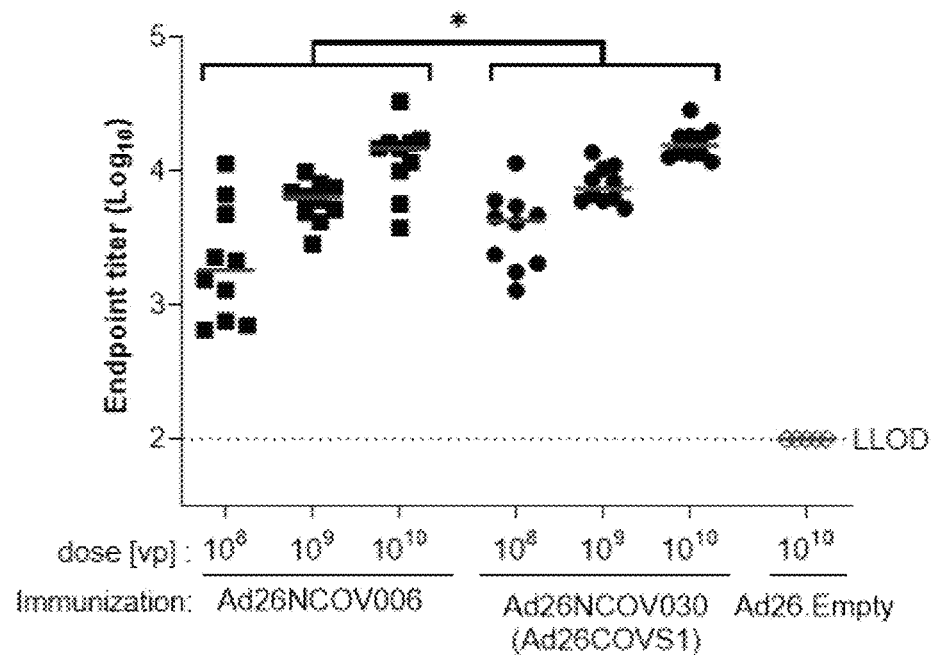
Figure 76B:
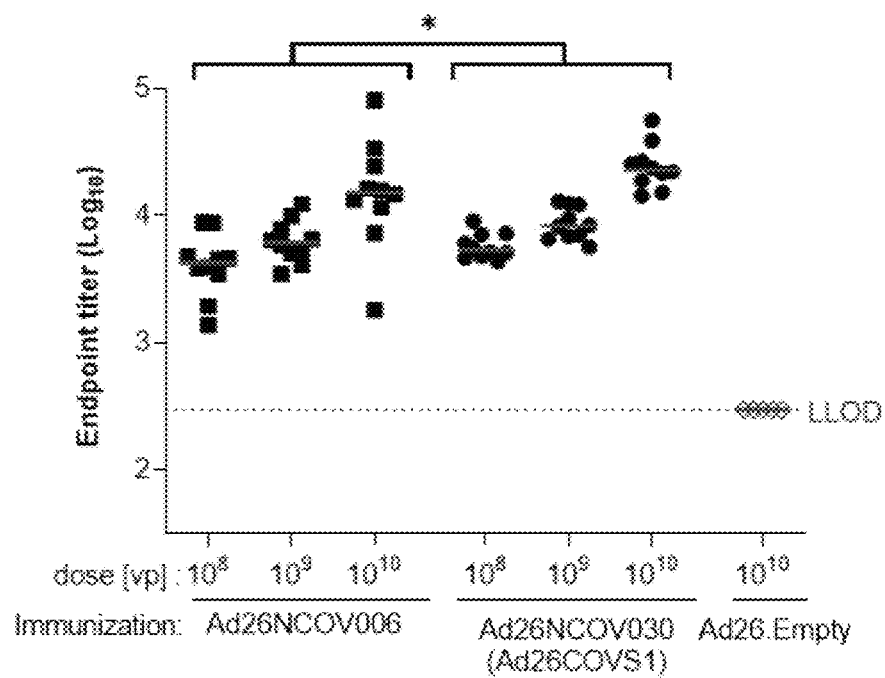

Furin site knock out (KO) and proline mutations (PP) increased the immunogenicity (ELISA on Furin KO+PP-S protein, see FIG. 72) Furthermore, the removal of the ER retention signal (dERRS) decreased CR3022 binding in CBE and reduced the immunogenicity.

Based on the CR3022:CR3015 binding ratios in CBE (together with the COR200011 data in FACS), the expression levels on WB (data not shown), the ELISA titers (as compared to COR200009, COR200010 and COR200011) after mouse DNA immunization (data not shown), and neutralization seen with COR200010 DNA, COR2000010 appeared the best antigen construct and was selected as antigen for adenovector construction.

Since, for membrane bound S protein the, a tPA signal peptide (ST) appeared to have no beneficial effect (based on CR3022 binding) when compared to wt SP in unstabilized versions, COR200007 was selected as well for adenovector construction.

Figures 73, 74, 75:
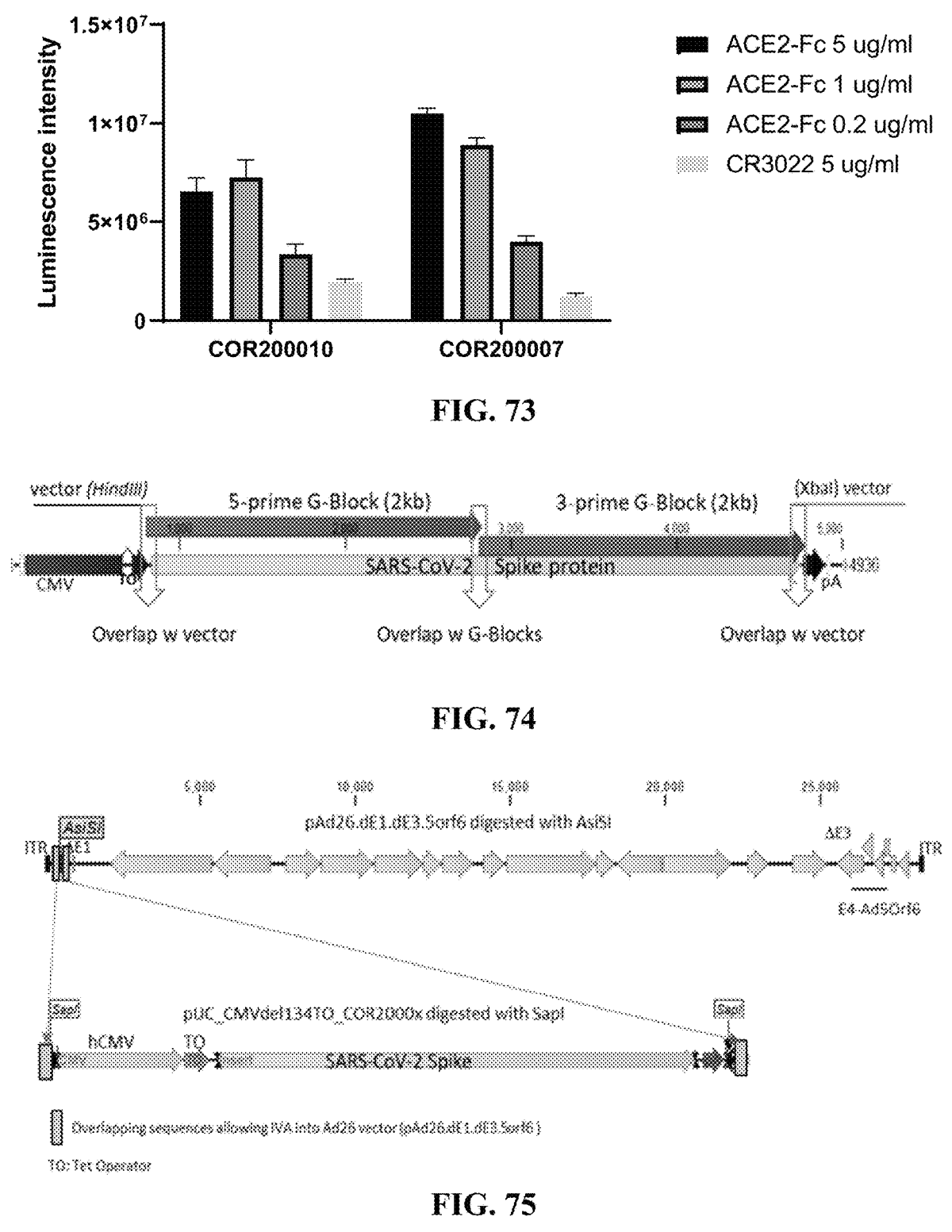

FIG. 73 shows that COR200007 binds better to ACE2 than COR200010.

Example 14: Cloning SARS-CoV-2 Vectors into Ad26

Several different inserts, as described in Example 13, were designed for Ad26 based on the S protein of SARS-CoV-2 sequence (whole genome sequence NC_045512). These protein sequences where reverse translated using most frequent human codon usage (CLC-main workbench; Qiagen) corrected for the GC content, cryptic splice sites, SD sequences, TATA boxes and termination signals, using open source bioinformatic tools (GeneOptimizer; GeneArt, Splice site and promoter prediction; fruitfly.org). Next the codon usage was harmonized between the different designs and nucleotides were added to the 5'-end comprising an overlap with the shuttle vector, an HindIII restriction site and a Kozak sequence (CGGCCGGGAACGGTGCATTG-GAAGCTTGCCACC (SEQ ID NO: 220) and to the 3'-end a double stop codon, XbaI restriction site and overlap sequence with the shuttle expression vector (TGA-TAATCTAGACGAGATCCGAACTTGTTTATTG (SEQ ID NO: 221) was added. Two DNA fragments (gBlocks provided by Integrated DNA Technologies, IDT) coding part of the SARS-CoV2 Spike protein sequences were then assembled into their HindIII+XbaI linearized target vector (ID 7346_pUC_E1-CMVdel134TO-stuffer, SEQ ID NO: 13) by Gibson assembly (NEBuilder® HiFi DNA Assembly Master Mix, NEB, Cat E2621), as schematically depicted in FIG. 74. This resulted in expression vectors encoding the antigen constructs COR20009, COR200010, COR200011 and COR200018.

FIG. 74 shows a schematic overview of the cloning of a functional expressing SARS-CoV-2 Spike protein. Two DNA fragments of approximately 2 kb (gBlocks; IDT)

coding the SARS-CoV-2 spike protein overlap with each other and overlap both the 5'- and 3'-ends which allows an in vitro assembly (IVA) of both DNA fragments into the linearized vector (as was described by Gibson et al; (2009) Nat Methods 6(5):345-345).

For the construction of COR20007 and COR20008 expression vectors, the vector pUC-CMVdel134TO_COR200010 respectively CMVdel134_COR200011 were used as templates for site directed mutagenesis approach to replace the tPA leader for wt Spike leader. Hereto a site directed PCR was performed using Q5-ste directed Mutagenesis kit (NEB; E0554S) according to manufacturer's protocol. With primers 7_fw (gctccccctcgtctccagtCAATGCGTGAACCTGACC (SEQ ID NO: 222) and 8_Rv (agtaccagaaacacgaa-catGGTGGCAAGCTTCCAATG (SEQ ID NO: 223) and PCR program denature 30 seconds at 98° C., followed by 25 cycles 98° C. for 20 seconds, melting at 64° C. for 20 seconds and elongation at 72 C for 2 minutes. The resulting amplicons were isolated from gel and treated with the KLD mixture according to manufacturer's protocol resulting in COR20007 and COR20008 expression vector.

The shuttle expression constructs were used for in vitro and in vivo assays (e.g., as described in Example 13) and for the generation of Ad26 Vector Genome Plasmid carrying the SARS-CoV-2 Spike sequences, as described below.

Generation of Ad26 Vector Genome Plasmid pAd26.dE1.dE3.5orf6 pAd26.dE1.dE3.5orf6 is a plasmid containing a full-length Ad26 vector genome that carries an E1 deletion, an E3 deletion, and a replacement of Ad26 E4 orf6 by that of Ad5, as described for previously generated Ad26-based vectors (Abbink et al., (2007); J Virol, 81(9),4654-4663). The plasmid backbone of pAd26.dE1.dE3.5orf6 comprises a pMB1 origin of replication and an ampicillin resistance gene, and is derived from pBR322 (GenBank accession J01749.1). pAd26.dE1.dE3.5orf6 further contains a unique AsiSI restriction site in place of the E1 deletion of the vector genome. These sites can be used to insert transgene cassettes from the shuttle vector (pShuttle_E1.CMVdel134TO; SEQ ID NO: 217) at the respective locations. Finally, the adenovirus vector genome within pAd26.dE1.dE3.5orf6 is flanked at each of its termini by a SwaI restriction site, allowing for its release from the plasmid backbone by SwaI digestion.

Generation of Ad26 Vector Genome Plasmids Carrying the SARS-CoV-2 Spike Sequences Plasmid pShuttle_E1.CMVdel134TO expression vector is carrying a human cytomegalovirus (hCMV) promoter that carries two tetracycline operator (tetO) sequences within the hCMV promoter and a SV40 poly Adenylation signal. Furthermore this vector contain both up and downstream of the transgene cassette a SapI restriction site flanked by 20 nt that are homologous to the receiving Ad26 vector (ID6598_pAd26.dE1.dE3.5orf6; SEQ ID NO: 218), which allow In Vitro Assembly (Gibson; 2009, supra) of the transgene cassette into the Ad26 vector.

FIG. 75 shows a schematic overview of the cloning of the shuttle vector expressing SARS-CoV-2 Spike protein into the E1 region of the Ad26 vector. The Ad26 vector is linearized with restriction enzyme AsiSI. The shuttle vector is digested with SapI to separate the expression casset from it's backbone. The expression cassette contains sequences that are homologous to the sequences flanking the AsiSI site in the Ad26 backbone which allows an in vitro assembly (IVA) of both DNA fragments (as was described by Gibson et al; 2009) To do so the pShuttle_E1.CMVdel134TO expression vectors carrying the SARS-CoV-2 Spike sequences were digested with SapI and expression cassette was isolated from gel in in vitro assembled (NEBuilder® HiFi DNA Assembly Master Mix, NEB, Cat E2621) into the AsiSI linearized Ad26 Vector (ID6598_pAd26.dE1.dE3.5orf6; SEQ ID NO: 218). This resulted in Ad26 vectors carrying the SARS-Cov-2 spike variants; pAd26.E1.CMVdel134-TO.COR20007, pAd26.E1.CMVdel134-TO.COR20008, pAd26.E1.CMVdel134-TO.COR20009, pAd26.E1.CMVdel134-TO-.COR200010, pAd26. E1.CMVdel134-TO.COR200011 and pAd26.E1.CMVdel134-TO.COR200018.

Recombinant Ad26 Vector Generation

Ad26 vectors containing the SARS-CoV2 insert were generated by transfection of full-genome plasmids into E1-complementing suspension PER.C6 TetR (sPER.C6 TetR) cells using standard operation procedures. Prior to transfection into sPER.C6 TetR, which were grown in Dulbecco's modified Eagle's medium (DMEM) supplemented with 10% fetal bovine serum (FBS) and 10 mM $MgCl_2$ in PLL coated plates, the Ad vector plasmid was digested with SwaI to release the adenoviral vector genome from the plasmid. The transfections were performed according to standard procedures using Lipofectamine transfection reagent (Invitrogen: Carlsbad, Calif.). After harvesting of the viral rescue transfections, the viruses were further amplified by several successive infection rounds on sPER.C6 TetR cells, cultured in Permexcis medium. The viruses were purified from crude viral harvests using a two-step cesium chloride (CsCl) density gradient ultracentrifigation procedure as described before (Havenga et al., "Novel replication-incompetent adenoviral B-group vectors: high vector stability and yield in PER.C6 cells," J. Gen. Virol. 87(8):2135-43 (2006)). Viral particle (VP) titers were measured by a spectrophotometry-based procedure described previously (Maizel et al., "The polypeptides of adenovirus: I. Evidence for multiple protein components in the virion and a comparison of types 2, 7A, and 12," Virology, 36(1):115-25 (1968)).

Example 15: Humoral Immunogenicity in Mice

BALB/c mice were immunized intramuscularly (IM) with a single dose of $10^8$, $10^9$ or $10^{10}$ vp Ad26COVS1 (N=10 per dose level). It is noted that the designations Ad26NCOV030 and Ad26COVS1 are used for the same construct and are used interchangeably. The negative control group received $10^{10}$ vp Ad26 vector with no transgene (Ad26.Empty, N=5). The Ad26NCOV006 vector, which encodes the native full-length S protein without the stabilizing mutations, allowed a comparison with Ad26COVS1 to assess the benefit of the stabilizing mutations. One group (Group 1, N=5) received $10^7$ vp Ad26NCOV006 for the purpose of serum generation and the results from this group are not presented. Serum was taken at Week 2 and Week 4 post immunization to measure the S protein binding antibody response and the SARS-CoV-2 neutralizing antibody response. S protein binding antibody titers were measured by ELISA.

S Protein Binding Antibody Response

A single immunization with Ad26COVS1 led to a dose level-dependent induction of S protein binding antibodies, with high antibody titers already 2 weeks post immunization (FIG. 76A). Compared with the Ad26NCOV006 vector encoding the S protein without stabilizing mutations, Ad26COVS1 induced significantly higher binding antibody titers at the Week 2 and Week 4 time points. The median response per group is indicated with a horizontal line. The dotted line indicates the LLOD.

Neutralizing Antibody Response

Figure 77A:
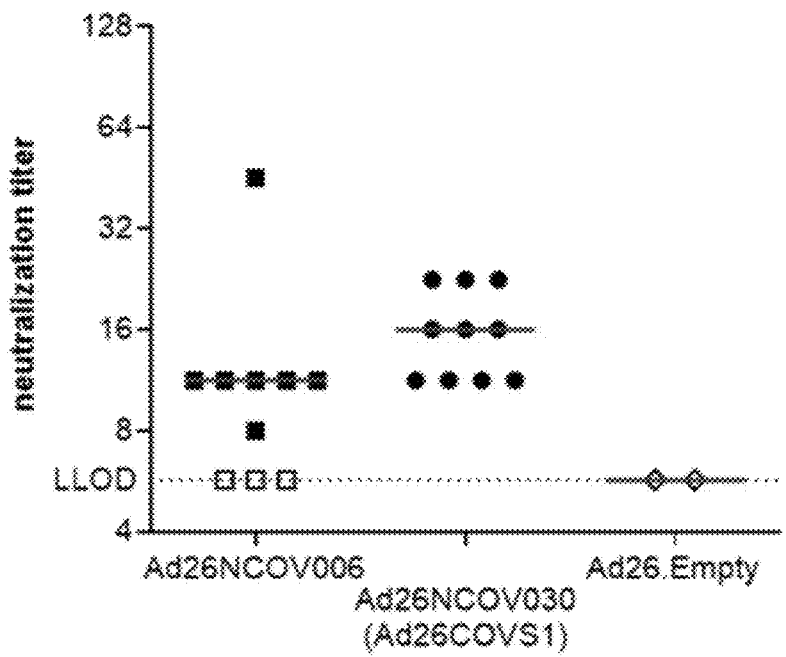
Figure 77B:
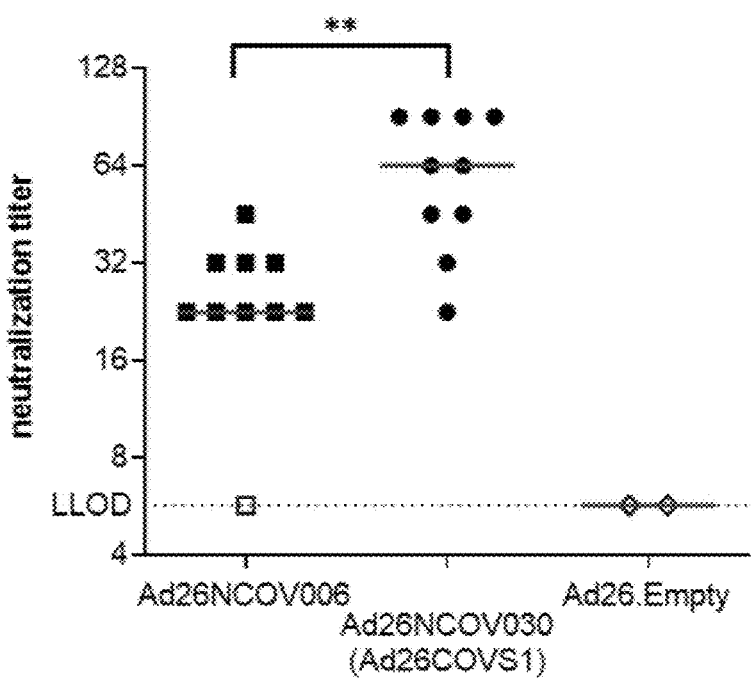

Serum samples from mice receiving $10^{10}$ vp Ad26COVS1 were used to determine the presence of neutralizing antibodies. Neutralizing antibody titers were measured by wtVNA determining the cytopathic effect (CPE) of virus isolate Leiden1 (L-001) on Vero E6 cells. The median response per group is indicated with a horizontal line. The dotted line indicates the LLOD. Animals with a response at or below the LLOD are shown as open symbols. A single immunization with Ad26COVS1 led to the induction of SARS-CoV-2 neutralizing antibodies as early as 2 weeks after immunization (FIG. 77). Median wtVNA neutralizing antibody titers induced by Ad26COVS1 increased by 4-fold to 64 (titer range: 22.6-90.5) from Week 2 to Week 4. Compared with Ad26NCOV006, Ad26COVS1 induced significantly higher neutralizing antibody titers at Week 4.

Example 16: Polarization of the Immune Response in Mice

This experiment was conducted to determine the Th1/Th2 balance induced by 2 Ad26-based SARS-CoV-2 vectors, including Ad26COVS1. This is an indirect measure for the theoretical risk of vaccine-associated disease enhancement. BALB/c mice (prone toward generating Th2-type responses) were immunized IM with a single dose of 1010 vp Ad26COVS1 (N=6). A control group received 50 pg recombinant stabilized S protein adjuvanted with 100 pg aluminum phosphate (AlPO$_4$; Adju-Phos®), which is generally known to induce a Th2 biased immune response (N=6). The negative control group received 100 pg AlPO$_4$ adjuvant only (N=3). Spleens and sera were taken at Week 2 post immunization to measure cellular and humoral immune responses.

S Protein Specific Cellular Cytokine Responses

To measure cytokine production, splenocytes were stimulated ex vivo with wild-type S protein peptide pools. On Day 13 after immunization mice were sacrificed, spleens were processed into single cell suspension, and splenocytes were stimulated ex vivo with 2 peptide pools of 15-mer peptides overlapping by 11 amino acids covering the complete wild-type SARS-CoV-2 S protein sequence. The sum of SFU from stimulation with peptide pools 1 and 2 is shown. IFN-γ production by splenocytes was measured by ELISpot after 18 hours of peptide stimulation. Cellular immune responses were determined by IFN-γ ELISpot, ICS, and Multiplex ELISA (using a 10-plex meso scale discovery [MSD] pro-inflammatory panel [mouse] kit).

Figure 78:
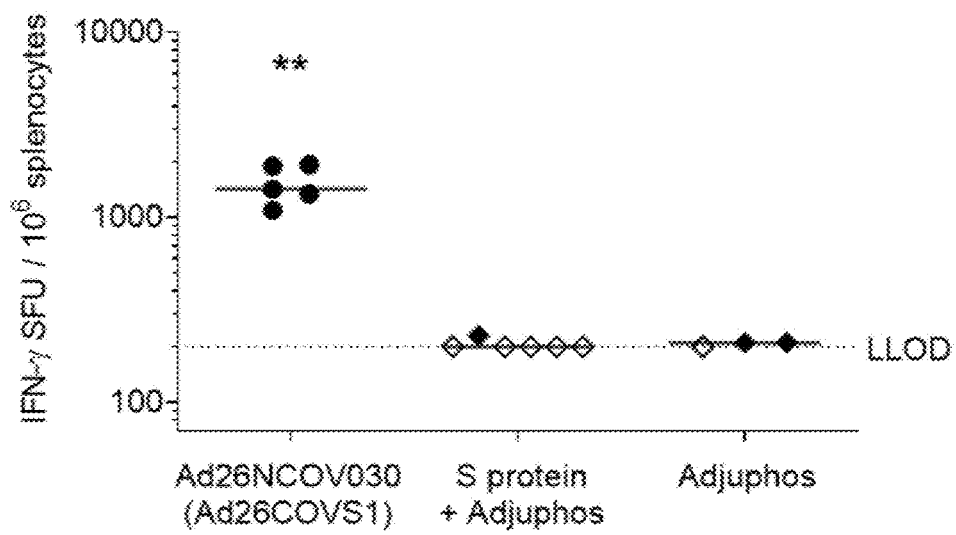
Figure 79A:
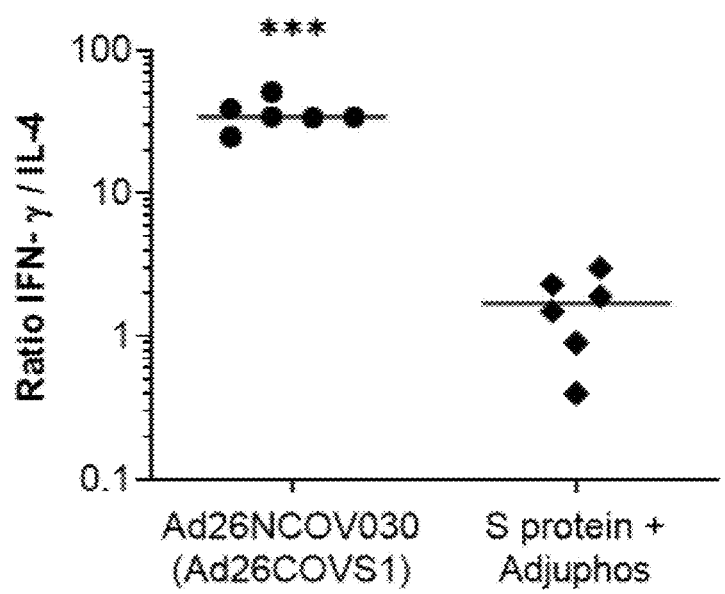
Figure 79B:
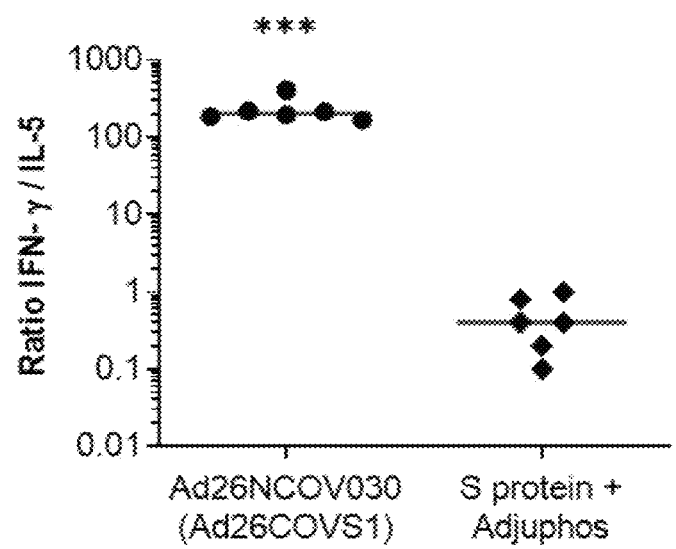
Figure 79C:
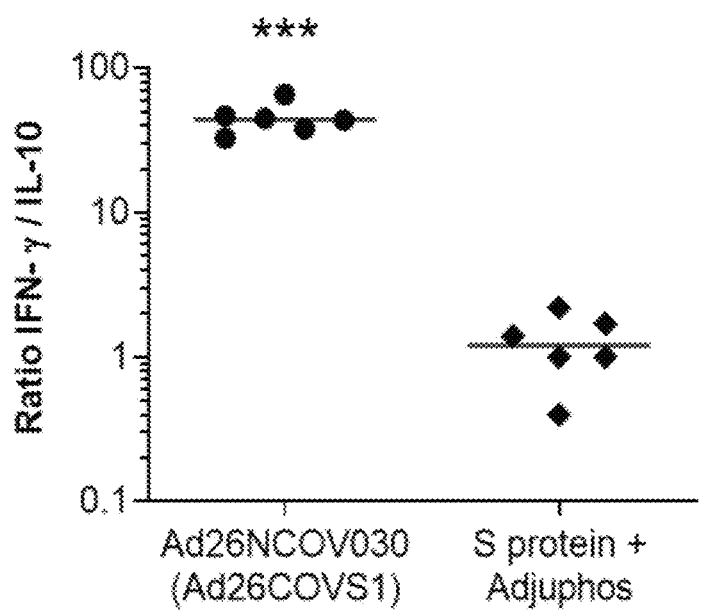

A single dose of Ad26COVS1 led to substantial secretion of IFN-γ measured by ELISpot, while recombinant S protein adjuvanted with AlPO4 induced an undetectable or low cellular immune response (FIG. 78). These results were confirmed by ICS with CD8+ T cells (data not shown). On Day 13 after immunization mice were sacrificed, spleens were processed into single cell suspension. Splenocytes were stimulated ex vivo for 48 hours with 2 peptide pools of 15-mers peptides overlapping by 11 amino acids covering the complete wild-type SARS-CoV-2 S protein sequence. Results shown are the ratios of the sums of pool 1 stimulations and pool 2 stimulations. Cytokine concentrations were measured in cell culture supernatant by Multiplex ELISA. While substantial secretion of IFN-γ, a hallmark of Th1 polarization, was observed after immunization with Ad26COVS1, secretion of typical cytokines associated with a Th2-type immune response, IL-4, IL-5, and IL-10, was low (data not shown). The ratio of cytokine concentrations of IFN-γ to either IL-4, IL-5, or IL-10, is considered indicative of the Th1 polarization of the immune response and is shown in FIG. 79. Immunization with Ad26COVS1 skewed the splenocyte response towards IFN-γ secretion. In comparison, immunization with S protein adjuvanted with AlPO$_4$ did not skew towards IFN-γ secretion, and overall cytokine secretion was low in this group.

S Protein Specific IgG Subtype Responses

Figure 80A:
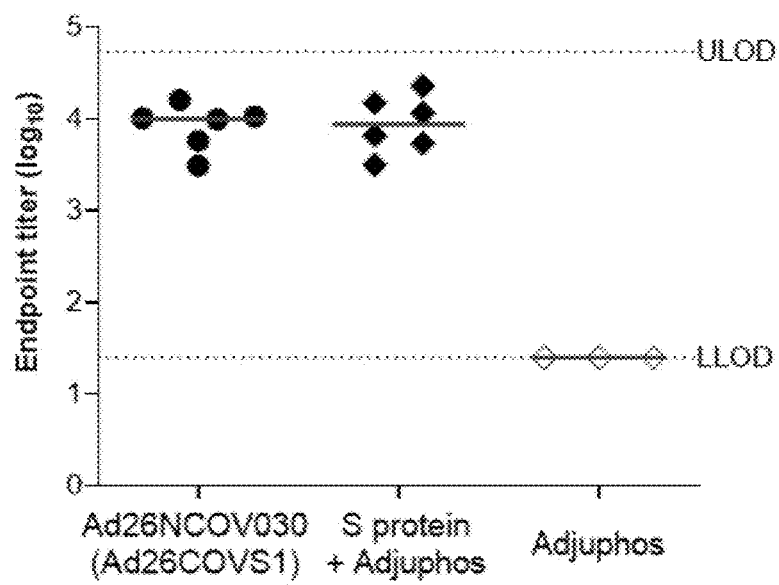
Figure 80B:
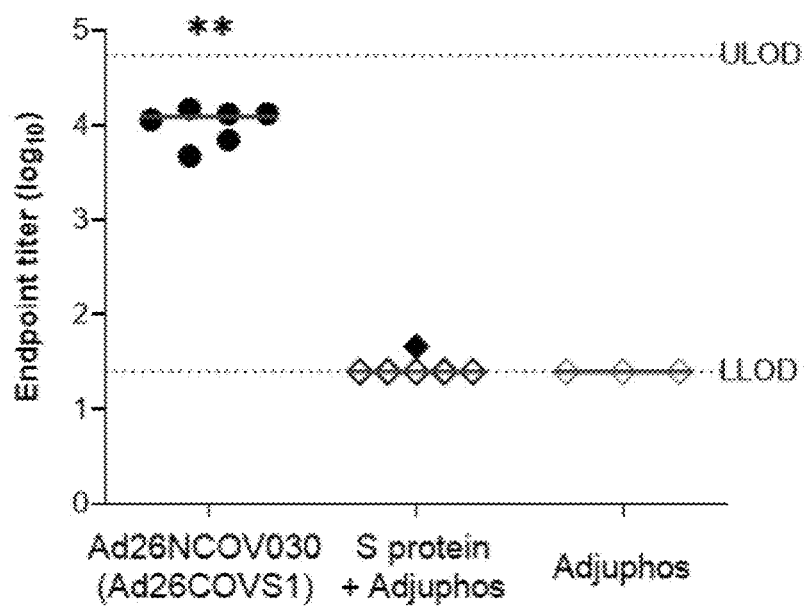
Figure 80C:
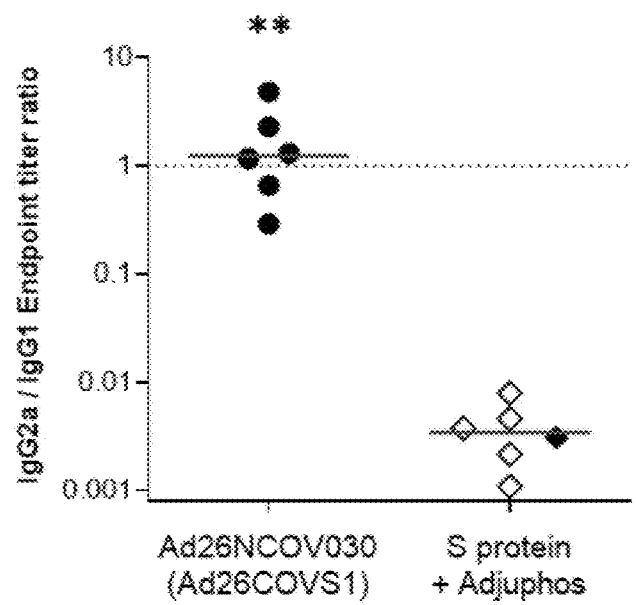

In mice, IgG1 is produced during any type of immune response, while IgG2a is predominantly produced during a Th1 polarized immune response, and therefore an increase of the IgG2a/IgG1 ratio is indicative of the Th1 skewing of the immune response. The IgG1 and IgG2a titers and the IgG2a/IgG1 ratio after immunization are shown in FIG. 80. Serum was sampled 13 days post immunization. S protein binding IgG1 and IgG2a titers were measured by ELISA. Ad26COVS1 induced S protein binding IgG1 and IgG2a antibodies in all animals. In contrast, S protein adjuvanted with AlPO4 induced IgG1 in all animals but IgG2a titers were near or at the lower limit of detection. This resulted in an IgG2a/IgG1 ratio after Ad26COVS1 immunization that was dominantly Th1-biased, and statistically different to the ratio observed after immunization with S protein adjuvanted with AlPO4, which is associated with a Th2 biased response.

Example 17: Immunogenicity in New Zealand White Rabbits

New Zealand White rabbits were immunized IM with a single dose of $5\times10^9$ vp or the clinical dose level of $5\times10^{10}$ vp Ad26COVS1 (N=5 per dose level). The negative control group received saline (N=5). The Ad26NCOV006 vector, which encodes the native full-length S protein without the stabilizing mutations, allowed a comparison with Ad26COVS1 to assess the benefit of the stabilizing mutations. The S protein binding antibody response and SARS-CoV-2 neutralizing antibody response were measured in serum taken at Week 2 post Dose 1. The S protein specific cellular response was measured in peripheral blood mononuclear cells (PBMC) taken at Week 3 post Dose 1.

S Protein Binding Antibody Response

Figure 81A:
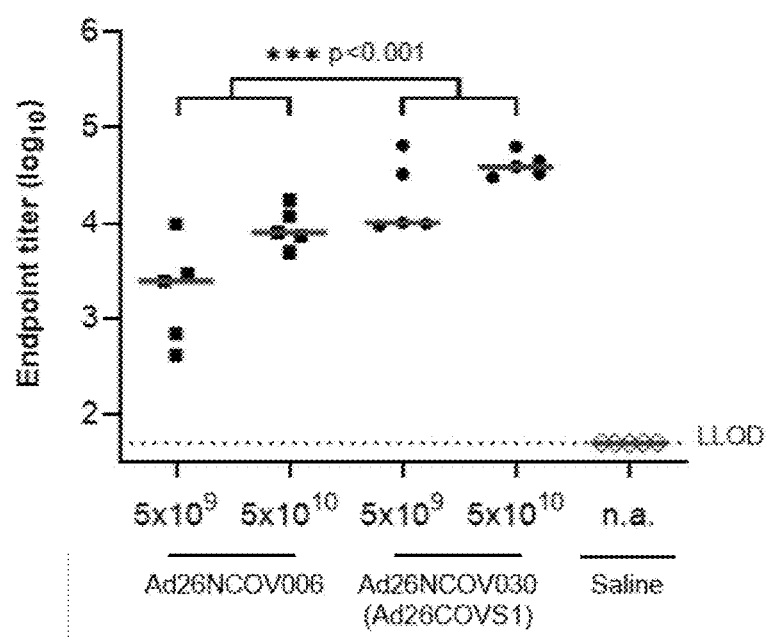

A single immunization with Ad26COVS1 led to a dose level-dependent induction of S protein binding antibodies (FIG. 81A). Compared with the Ad26NCOV006 vector encoding the S protein without stabilizing mutations, Ad26COVS1 induced significantly higher binding antibody titers.

Neutralizing Antibody Response

Figure 81B:
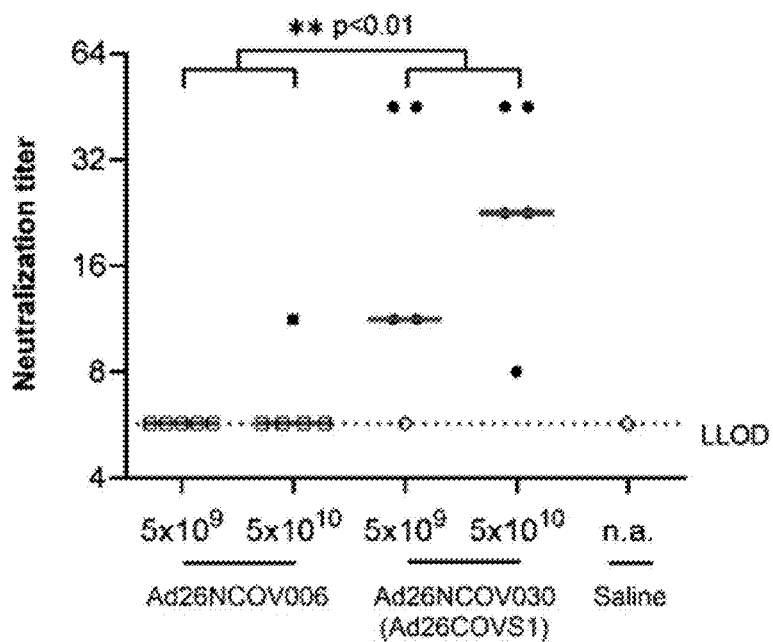

A single immunization with Ad26COVS1 led to a dose level-dependent induction of SARS-CoV-2 neutralizing antibodies, with a response in all animals that received the higher dose level of $5\times10^{10}$ vp (FIG. 81B). Neutralization titers were low and variable, which is likely due to the early assay time point (Week 2). Compared with the Ad26NCOV006 vector encoding the S protein without stabilizing mutations, Ad26COVS1 induced significantly higher neutralizing antibody titers.

S Protein Specific Cellular Cytokine Response

Figure 82:
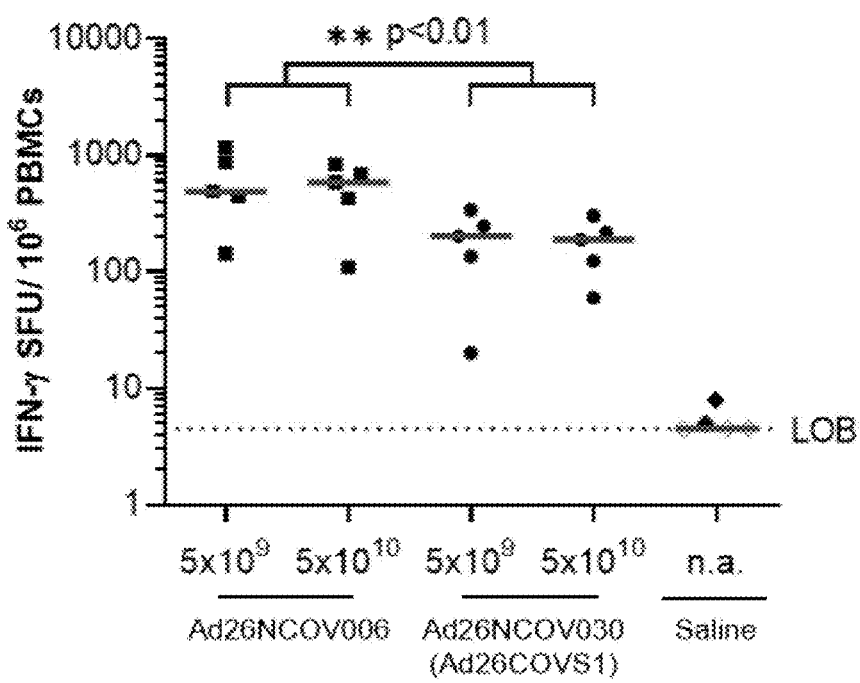

To measure cellular immunogenicity, PBMC were stimulated ex vivo with wild-type S protein peptide pools and the cellular immune response was determined by IFN-γ ELISpot. On Day 21 after immunization, PBMC were isolated and stimulated ex vivo with 2 peptide pools of 15-mers peptides overlapping by 11 amino acids covering the complete wild-type SARS-CoV-2 S protein sequence. IFN-γ production by PBMC was measured after 18 hours of peptide stimulation by ELISpot. When measured 3 weeks post Dose 1, Ad26COVS1 induced a dose-level independent cellular response in all animals, although the response was lower than after immunization with the Ad26NCOV006 vector encoding the native S protein, i.e. without stabilizing mutations (FIG. 82). This confirmed the induction of the Th1 associated cytokine IFN-γ already observed in a murine study with Ad26COVS1.

Example 18: Immunogenicity and Efficacy in Syrian Hamsters

Syrian hamsters were immunized IM with $10^9$ or $10^{10}$ vp Ad26COVS1 (N=6 per group) in a 1-dose regimen (Groups 5 and 6), or in a 2-dose regimen with a 4-week interval (Groups 13 and 14). Ad26NCOV006, which encodes the native full length S protein without the stabilizing mutations, was given at the same dose levels and regimens as Ad26COVS1 (N=6 per group, 1-dose Groups 1 and 2, 2-dose Groups 9 and 10) and allowed a comparison to assess the benefit of the Ad26COVS1 stabilizing mutations. The negative control groups received Ad26.Empty (N=6 per group) in a 1-dose and 2-dose regimen (Groups 7 and 8, and Group 15, respectively). The S protein binding antibody response and SARS-CoV-2 neutralizing antibody response were measured in serum taken at Week 4 post Dose 1. Animals receiving the 1-dose regimen were challenged with SARS-CoV-2 at Week 4, with a follow-up period of 4 days.

S Protein Binding Antibody Response and Neutralizing Antibody Response

Figure 83A:
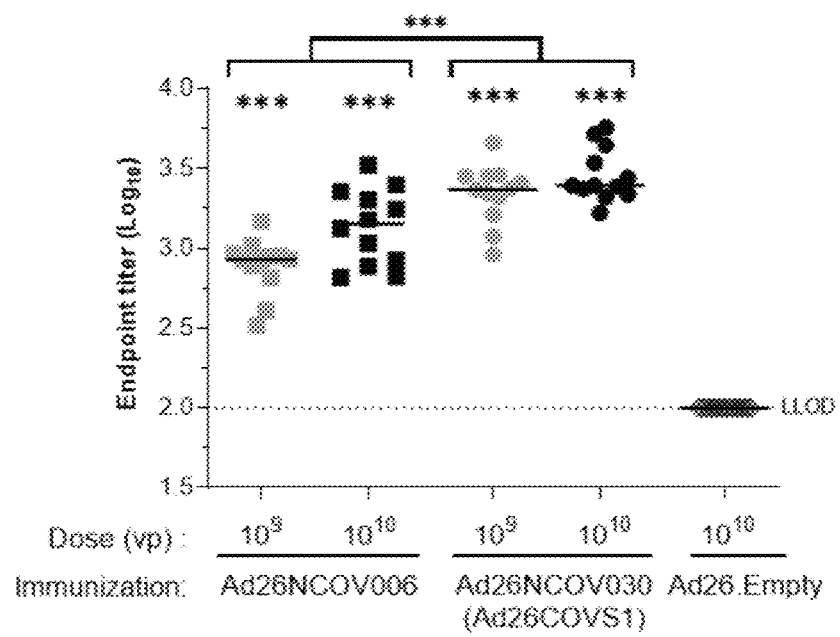
Figure 83B:
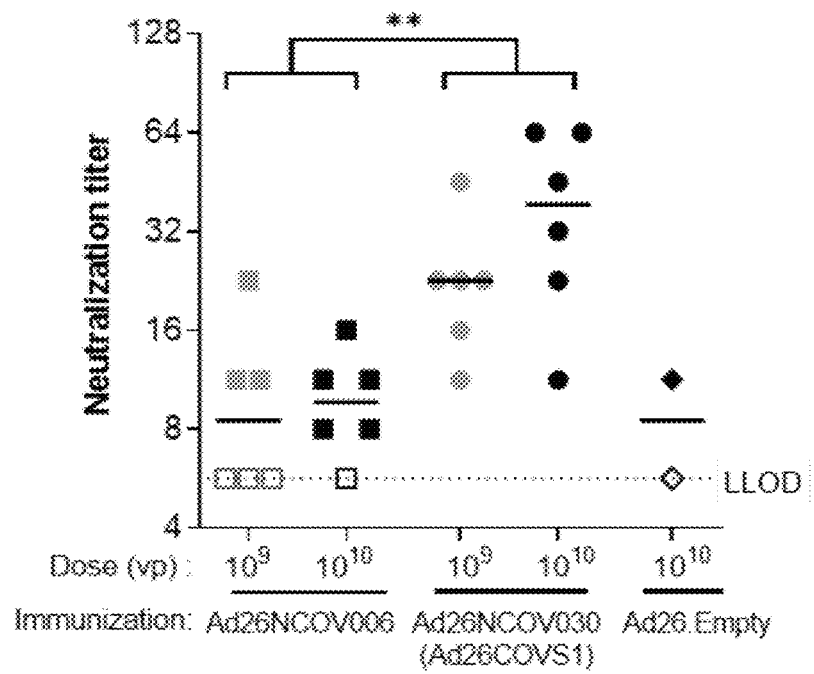

Serum was sampled 28 days post immunization. S protein binding antibody titers were measured by ELISA. Ad26.Empty sample N=18 (FIG. 83A). Neutralizing antibody titers were measured by wtVNA determining the cytopathic effect (CPE) of virus isolate Leiden1 (L-001) on Vero E6 cells (FIG. 83B). A single immunization with Ad26COVS1 led to the induction of S protein binding antibodies and SARS-CoV-2 neutralizing antibodies, measured at Week 4 post Dose 1, i.e., at the time of challenge for animals receiving the 1-dose regimen (FIGS. 83A and 83B).

Viral Load

Syrian hamsters were intramuscularly immunized with $1\times10^9$ or $1\times10^{10}$ vp of Ad26COVS1 (Ad26NCOV030) or Ad26NCVO006 (Ad26 vector encoding the native S protein) (N=6 per dose level) or Ad26.Empty (Ad26 vector not coding any COVID-19 antigens, N=6). The hamsters received intranasal challenge with $10^2$ TCID50 SARS-CoV-2 strain BetaCoV/Munich/BavPat1/2020 4 weeks (Day 28) post immunization. Lung tissue was isolated at the end of the challenge phase (Day C4) for viral load analysis. Replication competent virus ($TCID_{50}$ per gram lung) was measured by plaque assay. Replication competent virus in lung tissue was determined 4 days post challenge by plaque assay.

Figure 84:
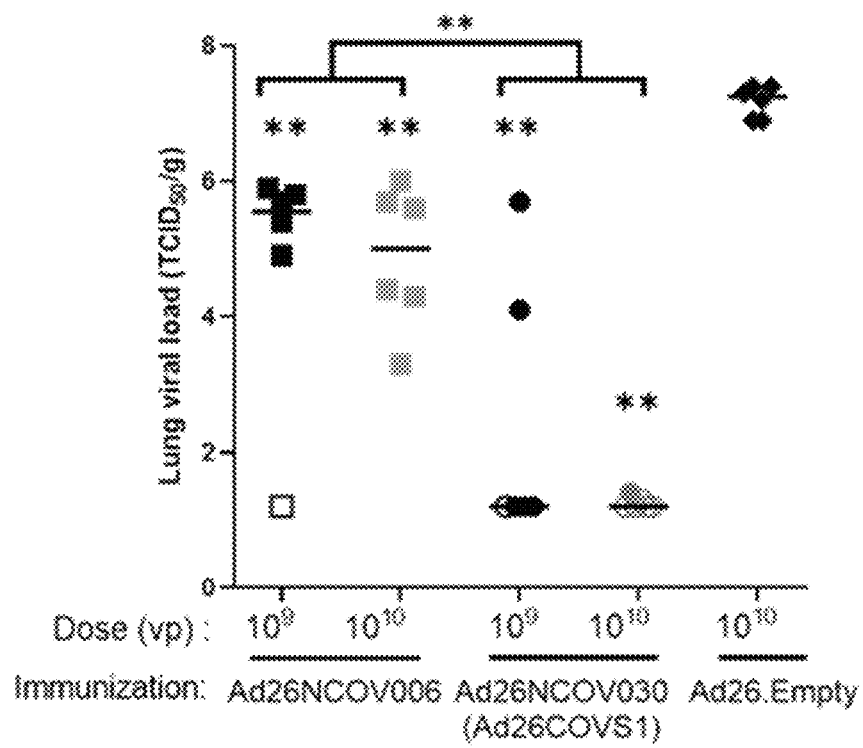

The mock-immunized control group that received Ad26.Empty had a high lung viral load 4 days post challenge. A single dose of Ad26COVS1 gave a significant reduction in viral load compared with the Ad26.Empty mock-immunized animals. Immunization with Ad26COVS1 resulted in significantly lower viral load compared with the Ad26NCOV006 vector encoding the S protein without stabilizing mutations (FIG. 84). Viral load was below the limit of detection for the majority of animals immunized with Ad26COVS1.

Body Weight Loss after Challenge

Figure 85:
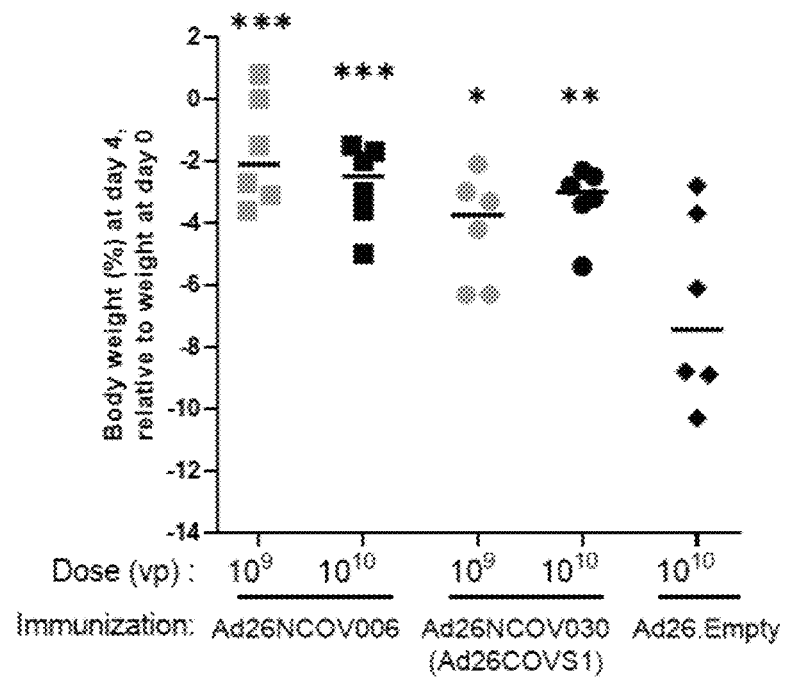

Body weight loss was determined as a measure of disease severity after challenge with SARS-CoV-2. A single dose of Ad26COVS1 gave a significant reduction of body weight loss compared with Ad26.Empty control immunized animals measured 4 days post challenge (FIG. 85). There was no significant difference in body weight loss across dose levels between the Ad26COVS1 and Ad26NCOV006 immunized groups (p=0.091 t-test from analysis of variance [ANOVA] with 3-fold Bonferroni correction).

Example 19: Immunogenicity in Nonhuman Primates (NHP)

NHP were immunized IM with a single dose of $10^{11}$ vp Ad26COVS1 (N=6) which corresponds to the high vaccine dose intended for clinical use. The negative control group received saline only (N=4). Serum to assess humoral immunogenicity was taken prior to immunization (Week 0, baseline) and at Week 2 and Week 4 post immunization. PBMC for cell-based assays were isolated on Week 0 and Week 4.

S Protein Binding Antibody Response and Neutralizing Antibody Response

In NHP, a single immunization with Ad26COVS1 induced S protein binding antibodies (FIG. 86A), and neutralizing antibodies measured by ppVNA (FIG. 86B) and wtVNA (FIG. 86C), as early as Week 2 post immunization. All assays are described in Chandrashekar et al. Science. 2020; eabc4776. doi: 10.1126/science.abc4776.

Compared with Week 2, Week 4 median binding antibody titers increased 3.3-fold to 16,497 (titer range: 4,450-57, 790). Median ppVNA neutralizing antibody titers increased by 5.8-fold to 408 (titer range: 208-643) from Week 2 to Week 4. Wild-type VNA neutralizing antibody titers were generally lower but showed a comparable increase over time; Week 4 median neutralizing antibody titers increased by 6.2 fold to 113 (titer range 53-234).

S Protein Specific Cellular Cytokine Response

Figure 86A:
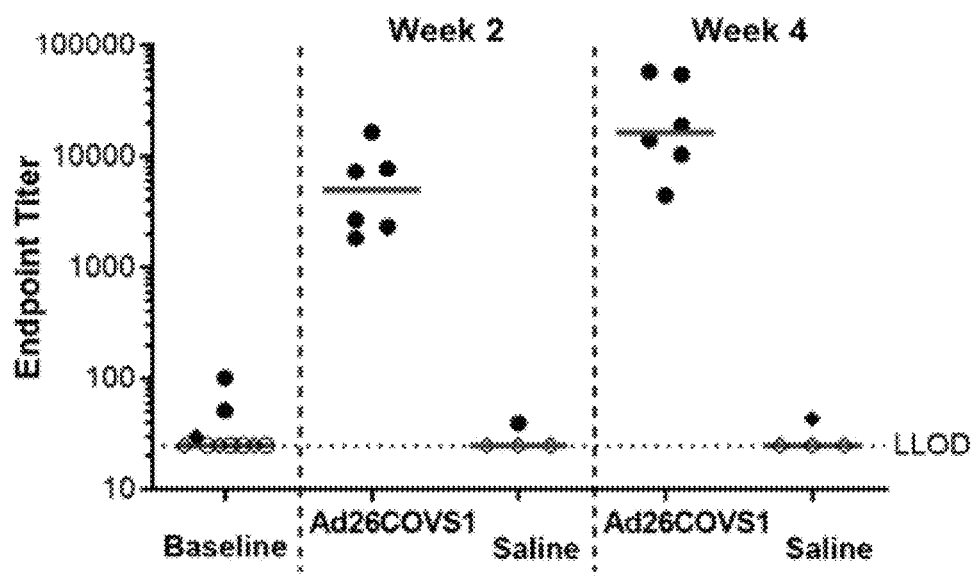
Figure 86B:
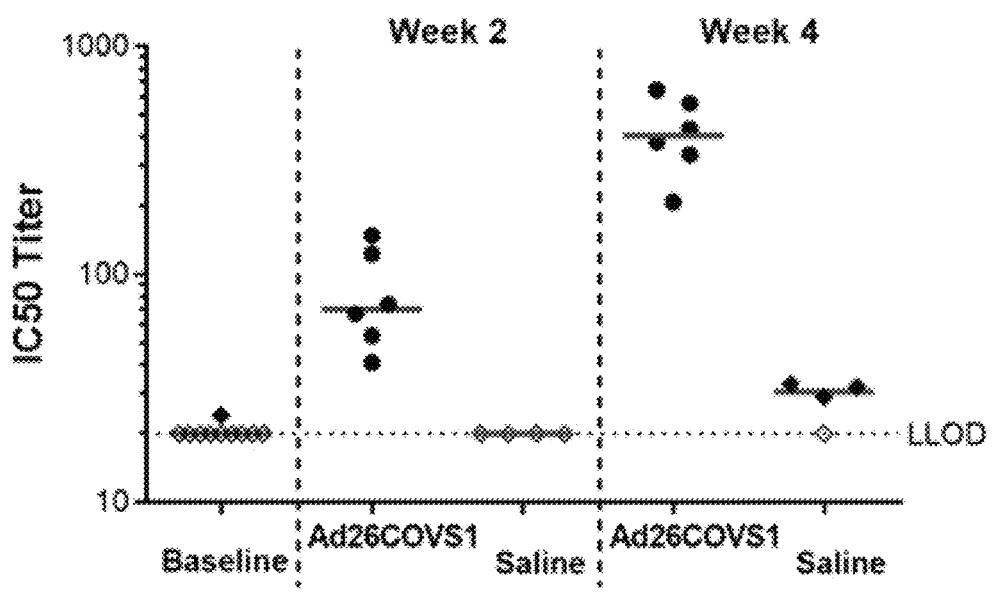
Figure 86C:
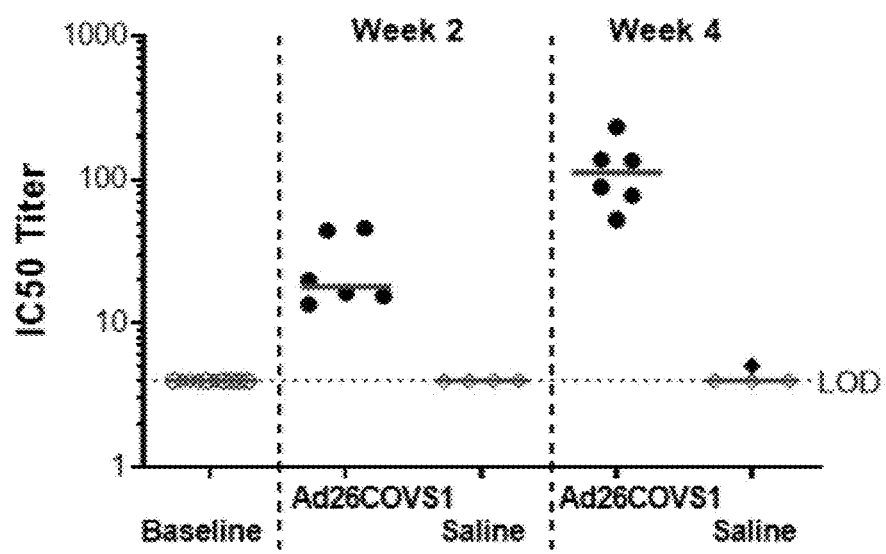
Figure 86D:
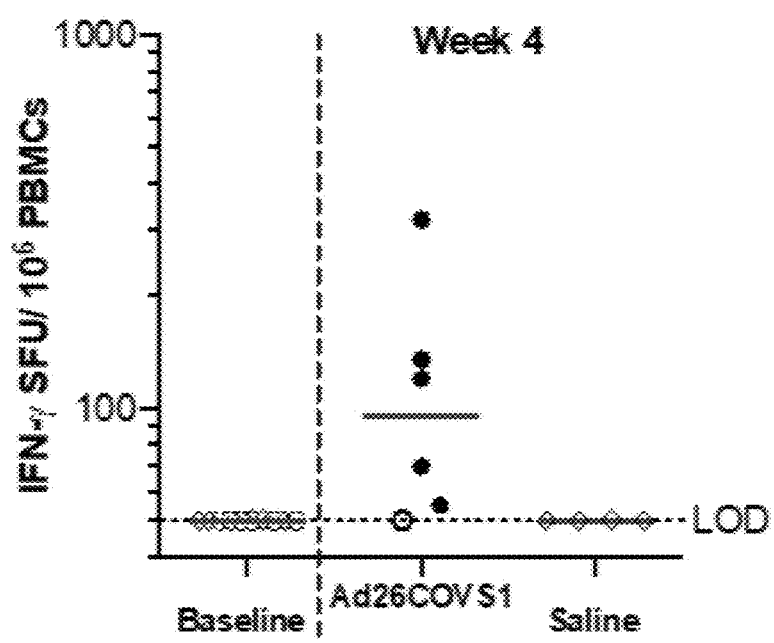

To measure cellular immunogenicity, PBMC were stimulated ex vivo with wild-type S protein peptide pools and the cellular immune response was determined by IFN-γ ELISpot. When measured 4 weeks post immunization, Ad26COVS1 induced a cellular response in 5 out of 6 animals (FIG. 86D). This confirmed the induction of the Th1 associated cytokine IFN-γ already observed in mice and rabbits with Ad26COVS1.

Example 20: Single-Shot Ad26 Vaccine Protects Against SARS-CoV-2 Challenge in Rhesus Macaques Generation and Immunogenicity of Ad26 Vaccine Candidates As described above, several Ad26 vectors expressing SARS-CoV-2 S protein variants were produced: (i) with the tissue plasminogen activator (tPA) leader sequence (LS) instead of the wild type (wt) LS (tPA.S; COR200009: SEQ ID NO: 207), (ii) tPA leader LS instead of wt LS with full-length S with mutation of the furin cleavage site and two proline stabilizing mutations (tPA.S.PP; COR200010: SEQ ID NO: 208), (iii) native full-length S (S; Wuhan/WIV04/2019), (iv) tPA and wildtype leader sequences with full-length S (tPA.WT.S; COR200018: SEQ ID NO: 210)), and (v) full-length S with mutation of the furin cleavage site and proline stabilizing mutations (S.PP; COR200007: SEQ ID NO: 205). Western blot analyses confirmed spike protein expression in cell lysates of cells that had been inoculated with each off all the vectors and absence of the furin cleavage products in cell lysates with spike variants with mutated furin cleavage sites (FIG. 87).

52 mixed-gender adult rhesus macaques, 6-12 years old, were immunized with Ad26 vectors expressing tPA.S (N=4), tPA.S.PP (N=4), S (N=4), tPA.WT.S (N=4), S.PP (N=6), and sham controls (N=20). Animals received an intramuscular single immunization of $10^{11}$ viral particles (vp) Ad26 vectors without adjuvant at week 0. RBD-specific binding antibodies were observed by ELISA in almost all vaccinated animals by week 2 and in all vaccinated animals by week 4 (FIG. 88A). Neutralizing antibody (NAb) responses were assessed using both a pseudovirus neutralization assay (Chandrashekar, A. et al. Science, doi:10.1126/science.abc4776 (2020); Yu, J. et al. Science, doi:10.1126/science.abc6284 (2020); Yang, Z. Y. et al. Nature 428, 561-564, doi:10.1038/nature02463 (2004)) (FIG. 88B) and a live virus neutralization assay (data not shown). NAb titers as measured by both neutralization assays were observed in the majority of vaccinated animals at week 2 and increased at week 4. The Ad26-S.PP (Ad26COVS1) vaccine elicited the highest pseudovirus NAb titers (median 408; range 208-643) and live virus NAb titers (median 113; range 53-233) at week 4. Median NAb titers in the Ad26-S.PP vaccinated macaques were 4-fold higher than median NAb titers in previously reported cohorts of 9 convalescent macaques and 27 convalescent humans following recovery from SARS-CoV-2 infection10 (FIG. 93). The Ad26-S.PP vaccine also induced low but detectable S-specific IgG and IgA responses in bronchoalveolar lavage (BAL) (FIG. 94).

Cellular immune responses were induced in the majority of vaccinated animals at week 4 by IFN-γ ELISPOT assays using pooled S peptides (FIG. 89A). Multiparameter intracellular cytokine staining assays were utilized to assess IFN-γ+CD4+ and CD8+ T cell responses (FIG. 89B). Responses were comparable in the various vaccine groups, although there was a trend towards lower responses with the Ad26-S.PP vaccine. IFN-γ+ and IL-2+CD4+ T cell responses were higher than IL-4+ and IL-10+CD4+ T cell responses (FIG. 95), suggesting induction of Th1-biased cellular immune responses.

Protective Efficacy of Ad26 Vaccine Candidates

At week 6, all animals were challenged with $1.2 \times 10^8$ VP ($1.1 \times 10^4$ PFU) SARS-CoV-2 by the intranasal (IN) and intratracheal (IT) routes (Chandrashekar, A. et al. Science, doi:10.1126/science.abc4776 (2020); Yu, J. et al. Science, doi:10.1126/science.abc6284 (2020)). Viral loads in bronchoalveolar lavage (BAL) and nasal swabs (NS) were assessed by RT-PCR for subgenomic mRNA (sgmRNA), which is believed to represent replicating virus (Chandrashekar, A. et al. supra; Wolfel, R. et al. Nature, doi: 10.1038/s41586-020-2196-x (2020).

Figure 90A:
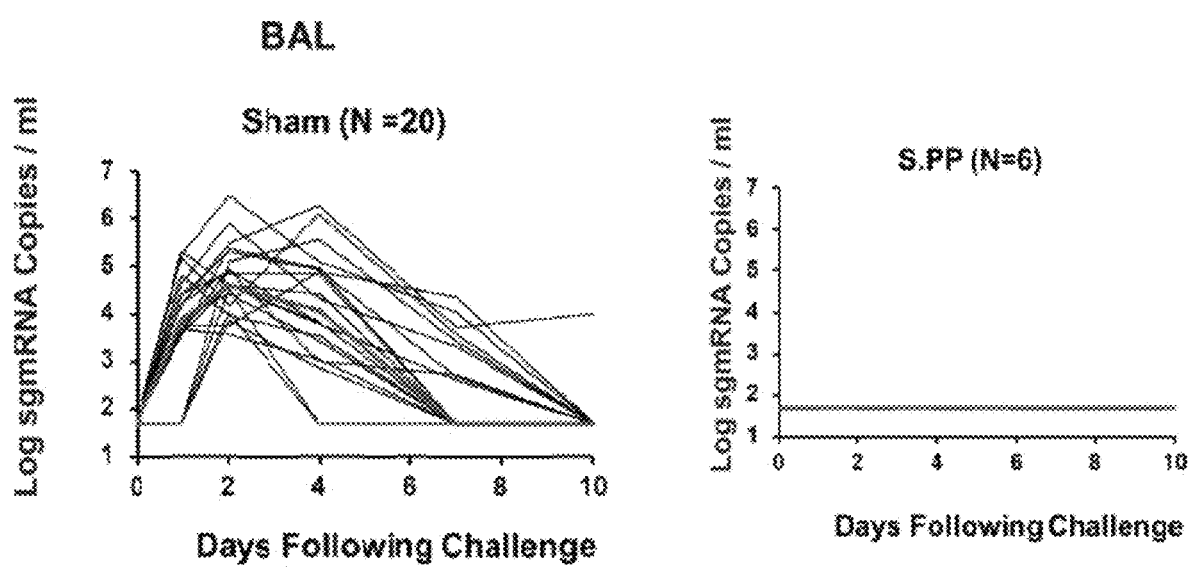
Figure 90B:
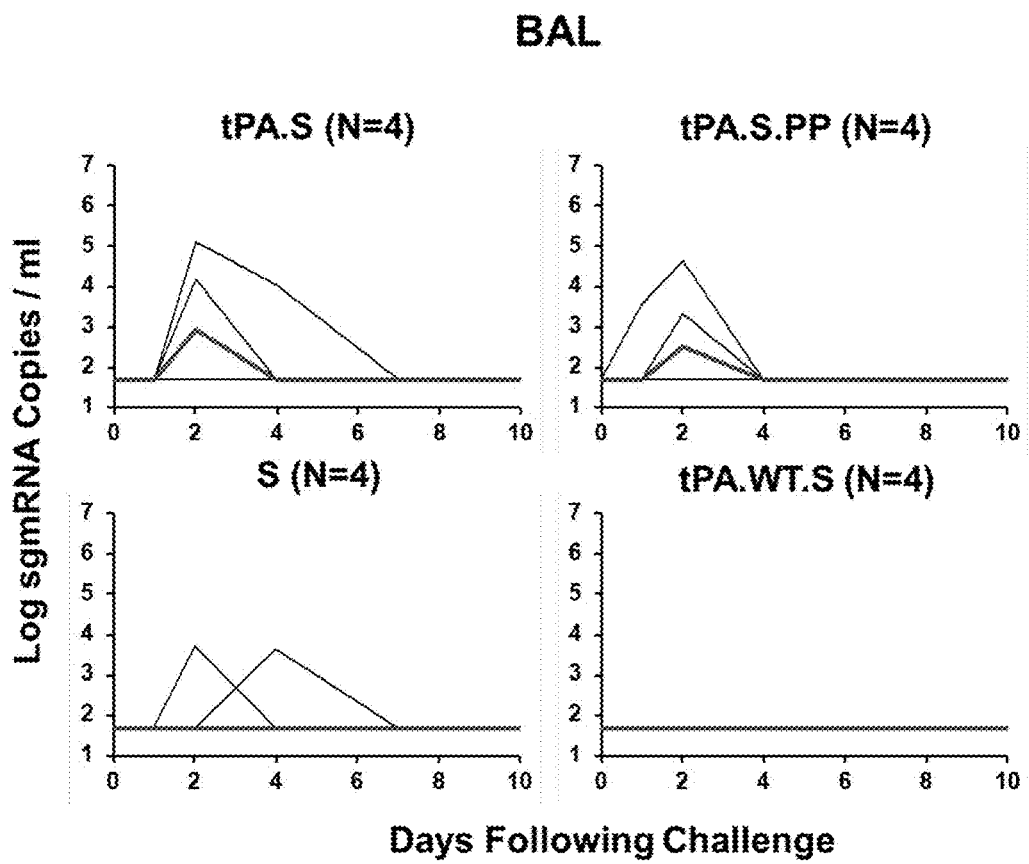
Figure 90C:
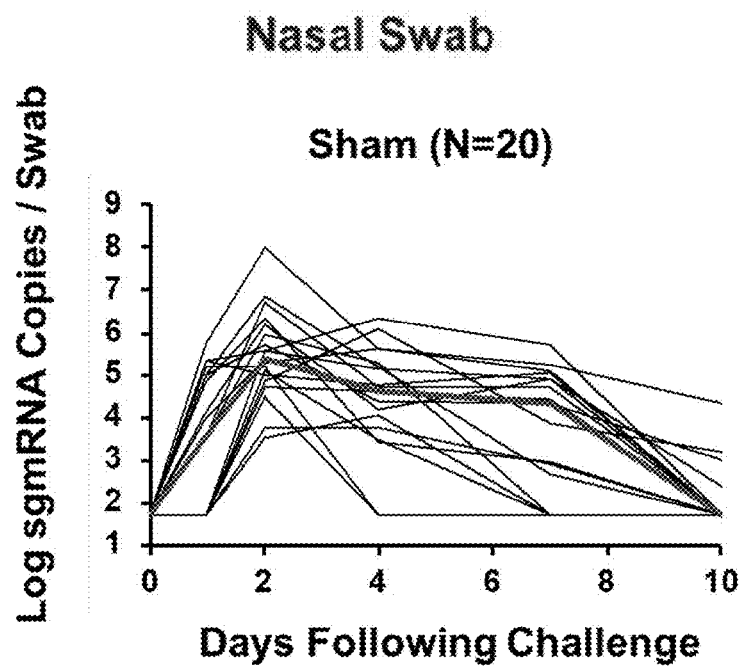

All 20 sham controls were infected and showed a median peak of 4.89 (range 3.85-6.51) $\log_{10}$ sgmRNA copies/ml in BAL (FIG. 90A). In contrast, animals that received Ad26-S.PP demonstrated no detectable virus in BAL (limit of detection 1.69 $\log_{10}$ sgmRNA copies/ml). Substantial protection was also observed with the other vaccines with occasional animals showing low levels of sgmRNA in BAL (FIG. 90B). Similarly, sham controls showed a median peak of 5.59 (range 3.78-8.01) log 10 sgmRNA in NS (FIG. 90C). One animal that received Ad26.S.PP had a low amount of virus in NS. The other vaccines generally demonstrated reduced viral loads in NS compared with controls, although the best protection was seen with Ad26.S.PP (FIG. 90D).

A comparison of peak viral loads in the vaccinated animals suggested that protection in BAL was generally more robust than in NS (FIG. 91). The Ad26-S.PP vaccine provided complete protection in lower respiratory tract and protection in 5/6 animals in upper respiratory tract, with >3.2 and >3.9 $\log_{10}$ reductions of median peak sgmRNA in BAL and NS, respectively, as compared with sham controls (P<0.0001 and P<0.0001, respectively, two-sided Mann-Whitney tests) (FIG. 91). These data support the relevance of prefusion stabilization of the S immunogen. Among the 32 vaccines, 17 animals were completely protected and had no detectable sgmRNA in BAL or NS following challenge, and 5 additional animals had no sgmRNA in BAL but showed some virus in NS.

Immune Responses in Ad26.S.PP Vaccinated Animals Following Challenge Sham controls developed robust pseudovirus NAb responses (FIG. 92) and CD8+ and CD4+ T cell responses (data not shown) by day 14 following SARS-CoV-2 challenge. CD8+ and CD4+ T cell responses in these animals were directed against multiple SARS-CoV-2 proteins, including spike (S1, S2), nucleocapsid (NCAP), and non-structural proteins (NS6, NS71, NS8). In contrast, animals that received the Ad26.S.PP vaccine did not demonstrate anamnestic NAb responses (FIG. 92) and only showed low T cell responses against spike (S1, S2) following challenge. These findings are consistent with the almost absent viral load data from these animals (FIG. 90-91) and suggest exceedingly low levels of virus replication in these animals, if any at all, following challenge.

The development of a safe and effective SARS-CoV-2 vaccine is a critical global priority. The present invention demonstrates that a single immunization with an Ad26 vector expressing an engineered S immunogen induced robust NAb responses and protected against SARS-CoV-2 challenge in rhesus macaques. The best vaccine in this study was Ad26-S.PP (Ad26COVS1 or Ad26NCOV030) which contains the wildtype leader sequence, the full-length membrane-bound S, a furin site mutation, and two prolines stabilizing mutations.

These data extend recent preclinical studies of inactivated virus and DNA vaccines for SARS-CoV-2 in nonhuman primates (Yu, J. et al. Science, doi:10.1126/science.abc6284 (2020); Gao, Q. et al. Science, doi:10.1126/science.abc1932 (2020)). Inactivated virus vaccines and nucleic acid vaccines typically require at least 2 immunizations, whereas adenovirus vector-based vaccines can induce robust and durable antibody responses after a single immunization. A single-shot SARS-CoV-2 vaccine would have important logistic and practical advantages compared with a two-dose vaccine for mass vaccination campaigns and pandemic control. However, it has also previously shown that a homologous boost with Ad26-HIV vectors can augment antibody titers by more than 10-fold in both nonhuman primates and humans, suggesting that both single-dose and two-dose regimens of the Ad26-S.PP vaccine should be evaluated in clinical trials. In the present study, Ad26.S.PP induced NAb responses after a single immunization and provided complete or near complete protection against SARS-CoV-2 challenge. Moreover, NAb titers and T cell responses in these animals did not substantially expand following challenge, and T cell responses did not broaden to non-vaccine antigens such as nucleocapsid and non-structural proteins, whereas sham controls generated robust NAb titers and T cell responses to multiple SARS-CoV-2 proteins following challenge. These data suggest minimal to no virus replication in the animals vaccinated with Ad26COVS1 following challenge.

In addition, it is worth noting that Ad26 vaccines elicited Th1-biased rather than Th2-biased CD4+ T cell responses, and animals that had sub-protective NAb titers did not demonstrate enhanced viral replication.

Materials and Methods

Animals and study design. 52 outbred Indian-origin adult male and female rhesus macaques (*Macaca mulatta*), 6-12 years old, were randomly allocated to groups. All animals were housed at Bioqual, Inc. (Rockville, Md.). Animals received Ad26 vectors expressing tPA.S (N=4), tPA.S.PP (N=4), S (N=4), tPA.WT.S (N=4), S.PP (N=6), and sham controls (N=20). Animals received a single immunization of $10^{11}$ viral particles (vp) Ad26 vectors by the intramuscular route without adjuvant at week 0. At week 6, all animals were challenged with $1.2 \times 10^8$ VP ($1.1 \times 10^4$ PFU) SARS-CoV-2 (USA-WA1/2020; NR-52281 stock; BEI Resources). Virus was administered as 1 ml by the intranasal (IN) route (0.5 ml in each nare) and 1 ml by the intratracheal (IT) route. All immunologic and virologic assays were performed blinded. All animal studies were conducted in compliance with all relevant local, state, and federal regulations and were approved by the Bioqual Institutional Animal Care and Use Committee (IACUC). Ad26 vectors were constructed with several versions of the SARS-CoV-2 spike (S) protein sequence (Wuhan/WIV04/2019). Sequences were codon optimized and synthesized. Replication-incompetent, E1/E3-deleted Ad26-vectors (Abbink, P. et al. J Virol 81, 4654-4663, doi:JVI.02696-06 [pii]10.1128/JVI.02696-06 (2007)) were produced in PER.C6.TetR cells using a plasmid containing the full Ad26 vector genome and a transgene expression cassette. Vectors were sequenced and tested for expression prior to use.

Western Blot. T-25 flasks seeded with 293T cells at 70-80% confluency were transiently transfected with SARS-Cov-2 Ad26 vectors and cell lysates were harvested 48 hours post-transfection and separately mixed with reducing sample buffer (Pierce), heated for 5 minutes at 95° C. and run on a precast 4-15% SDS-PAGE gel (Bio-Rad). Protein was transferred to a polyvinylidene difluoride (PVDF) membrane using an iBlot dry blotting system (Invitrogen), and membrane blocking performed overnight at 4° C. in Dulbecco's phosphate-buffered saline T (D-PBST) containing 0.2% Tween 20 (Sigma) (V/V) and 5% (W/V) non-fat milk powder. Following overnight blocking, the PVDF membrane was incubated for 1 hour in 3% milk DPBS-T containing a 1:10,000 dilution of polyclonal guinea pig anti-SARS antibody (BEI resources) for 1 hour. After this incubation, the PVDF membrane was washed five times with 5% milk DPBS-T and subsequently incubated with 1:30,000 anti-guinea pig or anti-rabbit horseradish peroxidase (HRP)-conjugated secondary antibody (Jackson Immunoresearch) in 3% milk DPBS-T. Finally, the PVDF membrane was washed again five times with 5% milk DPBS-T, and developed using an Amersham ECL Plus Western blotting detection system (GE Healthcare).

Subgenomic mRNA assay. SARS-CoV-2 E gene subgenomic mRNA (sgmRNA) was assessed by RT-PCR using an approach similar to previously described[9,10,20]. To generate a standard curve, the SARS-CoV-2 E gene sgmRNA was cloned into a pcDNA3.1 expression plasmid; this insert was transcribed using an AmpliCap-Max T7 High Yield Message Maker Kit (Cellscript) to obtain RNA for standards. Prior to RT-PCR, samples collected from challenged animals or standards were reverse-transcribed using Superscript III VILO (Invitrogen) according to the manufacturer's instructions. A Taqman custom gene expression assay (ThermoFisher Scientific) was designed using the sequences targeting the E gene sgmRNA20. Reactions were carried out on a QuantStudio 6 and 7 Flex Real-Time PCR System (Applied Biosystems) according to the manufacturer's specifications. Standard curves were used to calculate sgmRNA in copies per ml or per swab; the quantitative assay sensitivity was 50 copies per ml or per swab.

PFU assay. For plaque assays, confluent monolayers of Vero E6 cells were prepared in 6-well plates. Indicated samples collected from challenged animals were serially diluted, added to wells, and incubated at 37° C. for 1 hr. After incubation, 1.5 mL of 0.5% methylcellulose media was added to each well and the plates were incubated at 37° C. with 5% $CO_2$ for 2 days. Plates were fixed by adding 400 µL ice cold methanol per well and incubating at −20° C. for 30 minutes. After fixation, the methanol was discarded, and cell monolayers were stained with 600 µL per well of 0.23% crystal violet for 30 minutes. After staining, the crystal violet was discarded, and the plates were washed once with 600 µL water to visualize and count plaques.

ELISA. Briefly, 96-well plates were coated with 1 µg/ml SARS-CoV-2 RBD protein (Aaron Schmidt, MassCPR) in 1×DPBS and incubated at 4° C. overnight. After incubation, plates were washed once with wash buffer (0.05% Tween20 in 1×DPBS) and blocked with 350 µL Casein block/well for 2-3 hours at room temperature. After incubation, block solution was discarded and plates were blotted dry. Serial dilutions of heat-inactivated serum diluted in Casein block were added to wells and plates were incubated for 1 hr at room temperature, prior to three further washes and subsequent 1 hr incubation with a 1:1000 dilution of anti-macaque IgG HRP (NIH NHP Reagent Program) in the dark at room temperature. Plates were then washed three times with wash buffer, and 100 µL of SeraCare KPL TMB SureBlue Start solution was added to each well; plate development was halted by the addition of 100 µL SeraCare KPL TMB Stop solution per well. The absorbance at 450 nm was recorded using a VersaMax or Omega microplate reader. ELISA endpoint titers were defined as the highest reciprocal serum dilution that yielded an absorbance >0.2. Log 10 endpoint titers are reported.

Pseudovirus neutralization assay. The SARS-CoV-2 pseudoviruses expressing a luciferase reporter gene were generated in an approach similar to as described previously[9,10,16]. Briefly, the packaging construct psPAX2 (AIDS Resource and Reagent Program), luciferase reporter plasmid pLenti-CMV Puro-Luc (Addgene), and spike protein expressing pcDNA3.1-SARS CoV-2 SΔCT were co-transfected into HEK293T cells with calcium phosphate. The supernatants containing the pseudotype viruses were collected 48 hours post-transfection; pseudotype viruses were purified by filtration with 0.45 µm filter. To determine the neutralization activity of the antisera from vaccinated animals, HEK293T-hACE2 cells were seeded in 96-well tissue culture plates at a density of $1.75 \times 10^4$ cells/well overnight. Two-fold serial dilutions of heat inactivated serum samples were prepared and mixed with 50 µL of pseudovirus. The mixture was incubated at 37° C. for 1 hour before adding to HEK293T-hACE2 cells. Forty-eight hours after infection, cells were lysed in Steady-Glo Luciferase Assay (Promega) according to the manufacturer's instructions. SARS-CoV-2 neutralization titers were defined as the sample dilution at which a 50% reduction in RLU was observed relative to the average of the virus control wells.

ELISPOT assay. ELISPOT plates were coated with mouse anti-human IFN-γ monoclonal antibody from BD Pharmingen at a concentration of 5 pg/well overnight at 4° C. Plates were washed with DPBS containing 0.25% Tween20, and blocked with R10 media (RPMI with 11% FBS and 1.1% penicillin-streptomycin) for 1 h at 37° C. The Spike 1 and Spike 2 peptide pools contain 15 amino acid peptides overlapping by 11 amino acids that span the protein sequence and reflect the N- and C-terminal halves of the protein, respectively. Spike 1 and Spike 2 peptide pools were prepared at a concentration of 2 pg/well, and 200,000 cells/well were added. The peptides and cells were incubated for 18-24 h at 37° C. All steps following this incubation were performed at room temperature. The plates were washed with coulter buffer and incubated for 2 h with Rabbit polyclonal anti-human IFN-γ Biotin from U-Cytech (1 μg/mL). The plates are washed a second time and incubated for 2 h with Streptavidin-alkaline phosphatase antibody from Southern Biotechnology (1 μg/mL). The final wash was followed by the addition of Nitor-blue Tetrazolium Chloride/5-bromo-4-chloro 3 Indolyl phosphate p-toludine salt (NBT/BCIP chromagen) substrate solution for 7 minutes. The chromagen was discarded and the plates were washed with water and dried in a dim place for 24 hours. Plates were scanned and counted on a Cellular Technologies Limited Immunospot Analyzer.

Intracellular cytokine staining assay. $10^8$ PBMCs/well were re-suspended in 100 μL of R10 media supplemented with CD49d monoclonal antibody (1 μg/mL). Each sample was assessed with mock (100 μL of R10 plus 0.5% DMSO; background control), peptide pools (2 μg/mL), or 10 μg/mL phorbol myristate acetate (PMA) and 1 μg/mL ionomycin (Sigma-Aldrich) (100 μL; positive control) and incubated at 37° C. for 1 h. After incubation, 0.25 μL of GolgiStop and 0.25 μL of GolgiPlug in 50 μL of R10 was added to each well and incubated at 37° C. for 8 h and then held at 4° C. overnight. The next day, the cells were washed twice with DPBS, stained with Near IR live/dead dye for 10 mins and then stained with predetermined titers of mAbs against CD279 (clone EH12.1, BB700), CD38 (clone OKT10, PE), CD28 (clone 28.2, PE CY5), CD4 (clone L200, BV510), CD45 (clone D058-1283, BUV615), CD95 (clone DX2, BUV737), CD8 (clone SK1, BUV805), for 30 min. Cells were then washed twice with 2% FBS/DPBS buffer and incubated for 15 min with 200 μL of BD CytoFix/CytoPerm Fixation/Permeabilization solution. Cells were washed twice with 1× Perm Wash buffer (BD Perm/Wash™ Buffer 10× in the CytoFix/CytoPerm Fixation/Permeabilization kit diluted with MilliQ water and passed through 0.22 μm filter) and stained with intracellularly with mAbs against Ki67 (clone B56, FITC), CD69 (clone TP1.55.3, ECD), MO (clone JES3-9D7, PE CY7), IL13 (clone JES10-5A2, BV421), TNF-α (clone Mab11, BV650), IL4 (clone MP4-25D2, BV711), IFN-γ (clone B27; BUV395), IL2 (clone MQ1-17H12, APC), CD3 (clone SP34.2, Alexa 700), for 30 min. Cells were washed twice with 1× Perm Wash buffer and fixed with 250 μL of freshly prepared 1.5% formaldehyde. Fixed cells were transferred to 96-well round bottom plate and analyzed by BD FACSymphony™ system.

Statistical analyses. Analysis of virologic and immunologic data was performed using GraphPad Prism 8.4.2 (GraphPad Software). Comparison of data between groups was performed using two-sided Mann-Whitney tests. Correlations were assessed by two-sided Spearman rank-correlation tests. P-values of less than 0.05 were considered significant.

Example 21: Ad26 Vaccine Protects Against SARS-CoV-2 Severe Clinical Disease in Hamster The clinical and virologic characteristics of high-dose SARS-CoV-2 infection in hamsters was assessed and the protective efficacy of an Ad26 vector-based vaccine according to the invention encoding a stabilized SARS-CoV-2 spike (S) was evaluated in this stringent model. 20 Syrian golden hamsters (10-12 weeks old) were inoculated with $5 \times 10^4$ $TCID_{50}$ (N=4; low-dose) or $5 \times 10^5$ $TCID_{50}$ (N=16; high-dose) SARS-CoV-2 by the intranasal route. In the high-dose group, 4 animals were necropsied on day 2, and 4 animals were necropsied on day 4 for tissue viral loads and histopathology, and the remaining 8 animals were followed longitudinally. All remaining animals were necropsied on day 14. In the low-dose group, hamsters lost a median of 14.7% of body weight by day 6 but fully recovered by day 14 (FIG. 96A, 96B), consistent with previous studies (Chan et al., Clin Infect Dis, doi:10.1093/cid/ciaa325, (2020); Sia et al., Nature, doi:10.1038/s41586-020-2342-5 (2020); Imai et al., Proc Natl Acad Sci USA 117, 16587-16595, (2020). In the high-dose group, hamsters lost a median of 19.9% of body weight by day 6. Of the 8 animals in this group that were followed longitudinally, 4 met IACUC humane euthanasia criteria of >20% weight loss and respiratory distress on day 6, and 2 additional animals met these criteria on day 7. The remaining 2 animals recovered by day 14. These data demonstrate that high-dose SARS-CoV-2 infection in hamsters led to severe weight loss and partial mortality.

Tissue viral loads were assessed in the 4 animals that received high-dose SARS-CoV-2 and were necropsied on day 2, the 4 animals that were necropsied on day 4, and 5 of 6 of the animals that met euthanasia criteria on day 6-7 (FIG. 96C). High median tissue viral loads on day 2 of $10^{12}$ RNA copies/g in lung tissue and $10^8$-$10^9$ 60 RNA copies/g in nares and trachea were observed, with a median of $10^5$-$10^8$ RNA copies/g in heart, gastrointestinal tract, brain, spleen, liver, and kidney, indicative of disseminated infection. By day 6-7, tissue viral loads were approximately 2 logs lower, despite continued weight loss.

Figure 97A:
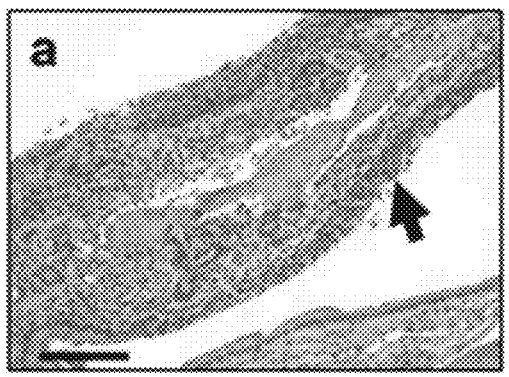
Figure 97B:
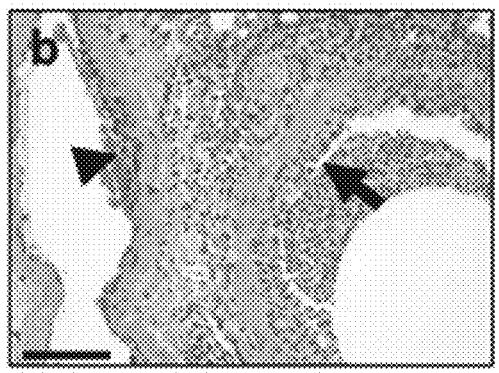
Figure 97C:
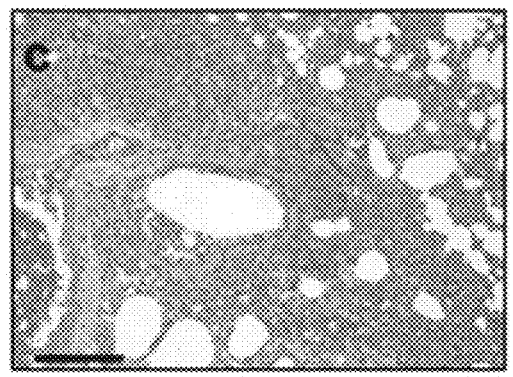
Figure 97D:
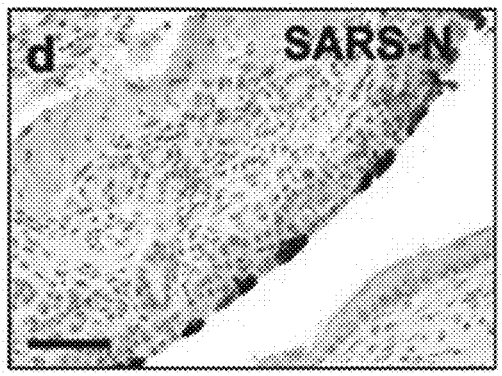
Figure 97E:
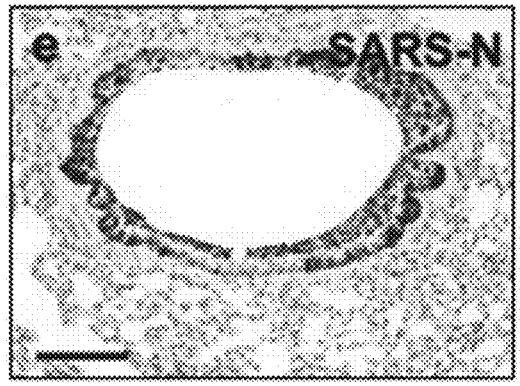
Figure 97F:
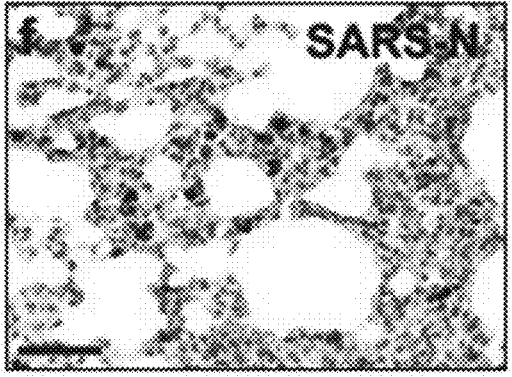
Figure 97G:
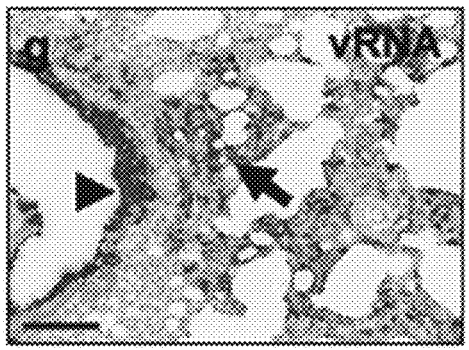
Figure 97H:
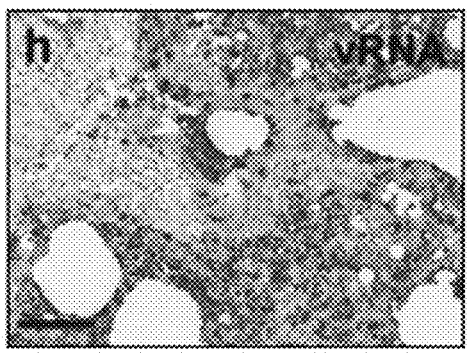

Hamsters infected with high-dose SARS-CoV-2 were assessed by histopathology on days 2 (N=4), 4 (N=4), 6-7 (N=6), and 14 (N=2). Infection was associated with marked inflammatory infiltrates and multifocal epithelial necrosis of the nasal turbinate (FIG. 97a) and bronchiolar epithelium, resulting in degenerative neutrophils and cellular debris in the lumen (FIG. 97b). The endothelium of nearby vessels was reactive with adherence of mononuclear cells to the endothelium and transmigrating within vessel walls, indicative of endothelialitis (FIG. 97b). There was moderate to severe multifocal interstitial pneumonia characterized by pulmonary consolidation affecting 30-60% of the lung parenchyma as early as day 2 following SARS-CoV-2 infection (FIG. 97c). Inflammatory infiltrates consisted of massive numbers of macrophages and neutrophils with fewer lymphocytes. The nasal turbinate epithelium (FIG. 97d) and bronchiolar epithelial cells (FIG. 97e) were strongly positive for SARS nucleocapsid protein (SARS-CoV-N) by immunohistochemistry (IHC) in regions of inflammation and necrosis. SARS-CoV-N IHC also showed locally extensive staining of the alveolar septa and interstitial mononuclear cells morphologically consistent with macrophages (FIG. 97f). Similarly, substantial SARS-CoV-2 viral RNA (vRNA) was observed in the bronchiolar epithelium and the pulmonary interstitium in regions of inflammation (FIG. 97g, 97h).

Figure 97I:
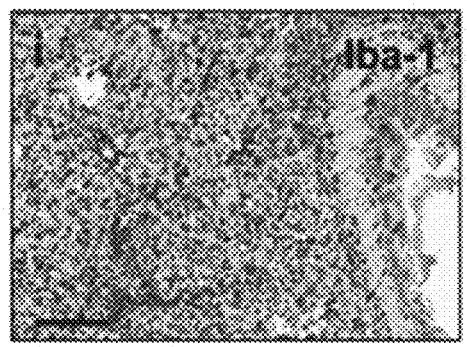
Figure 97J:
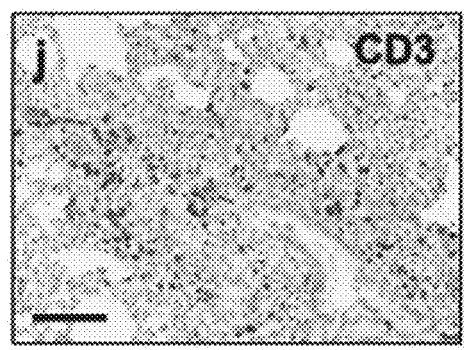
Figure 97K:
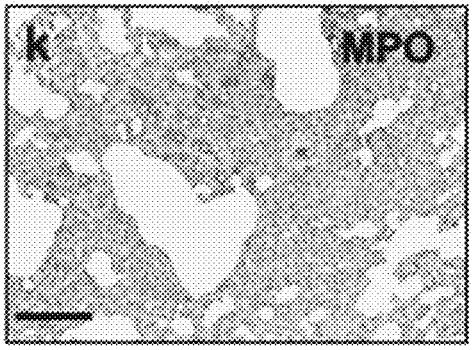
Figure 97L:
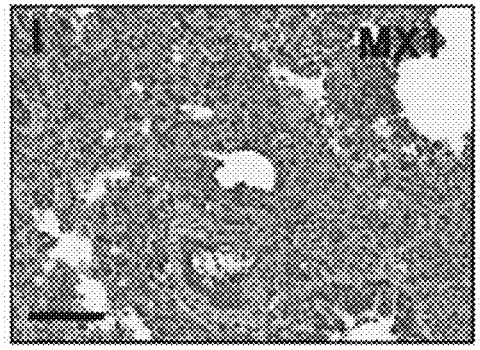

Levels of both SARS-CoV-2 vRNA and SARS-CoV-N protein expression in lung were highest on day 2 and diminished by day 4, with minimal vRNA and SARS-CoV-N protein detected by day 7 (FIG. 100). The pneumonia was characterized by large inflammatory infiltrates of Iba-1+ macrophages in the lung interstitium as well as CD3+T lymphocytes (FIG. 97i, 97j). Numerous viable and degenerative neutrophils were detected throughout the lung, especially in regions of necrosis, with high expression of neutrophil myeloperoxidase (MPO) throughout the lung (FIG. 97k). Diffuse expression of the interferon inducible gene product, MX1, was also detected in the lung (FIG. 97l). In contrast with the kinetics of SARS-CoV-2 vRNA and SARS-CoV-N detection, which peaked on day 2, these markers of inflammation peaked on day 7 (FIG. 100), coincident with maximal weight loss and mortality (FIG. 96A, 96B). Detection of vRNA in the lung by RNAscope did not simply reflect the viral inoculum, as we detected not only negative anti-sense vRNA but also positive-sense vRNA, which overlapped in location and pattern, from day 2 to day 7 post challenge. SARS-CoV-2 vRNA expression (both anti-sense and sense) was present in lung with robust ACE2 receptor expression (data not shown).

Figure 98A:
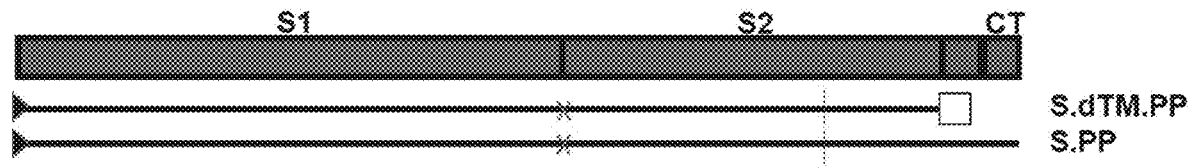
Figure 98B:
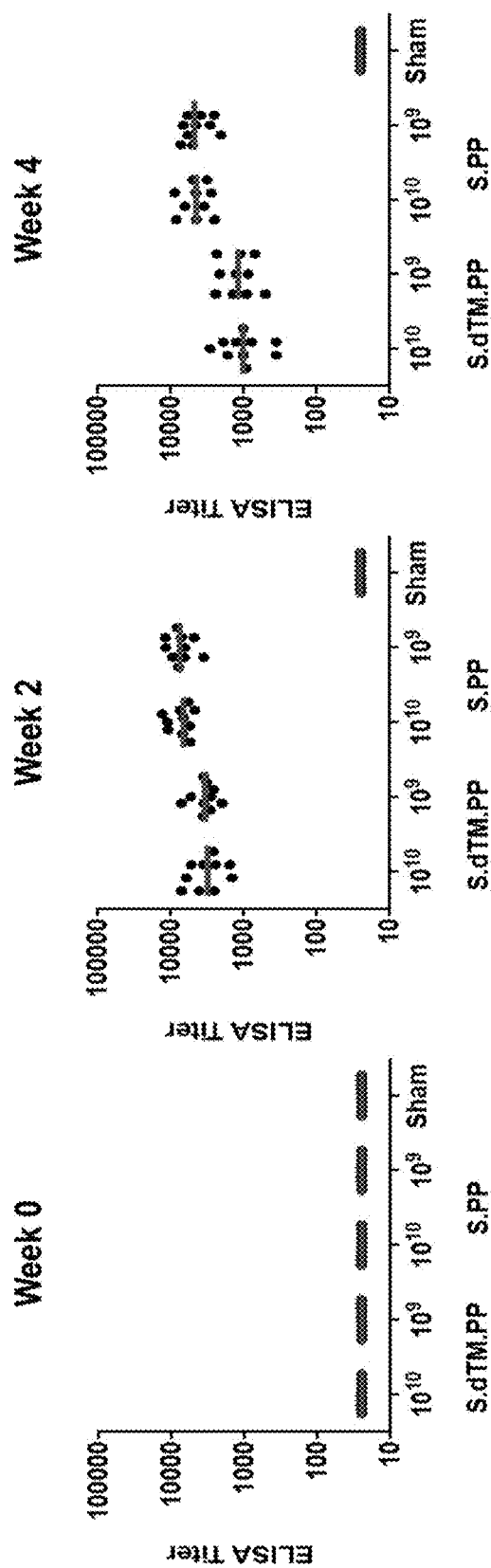
Figure 98C:
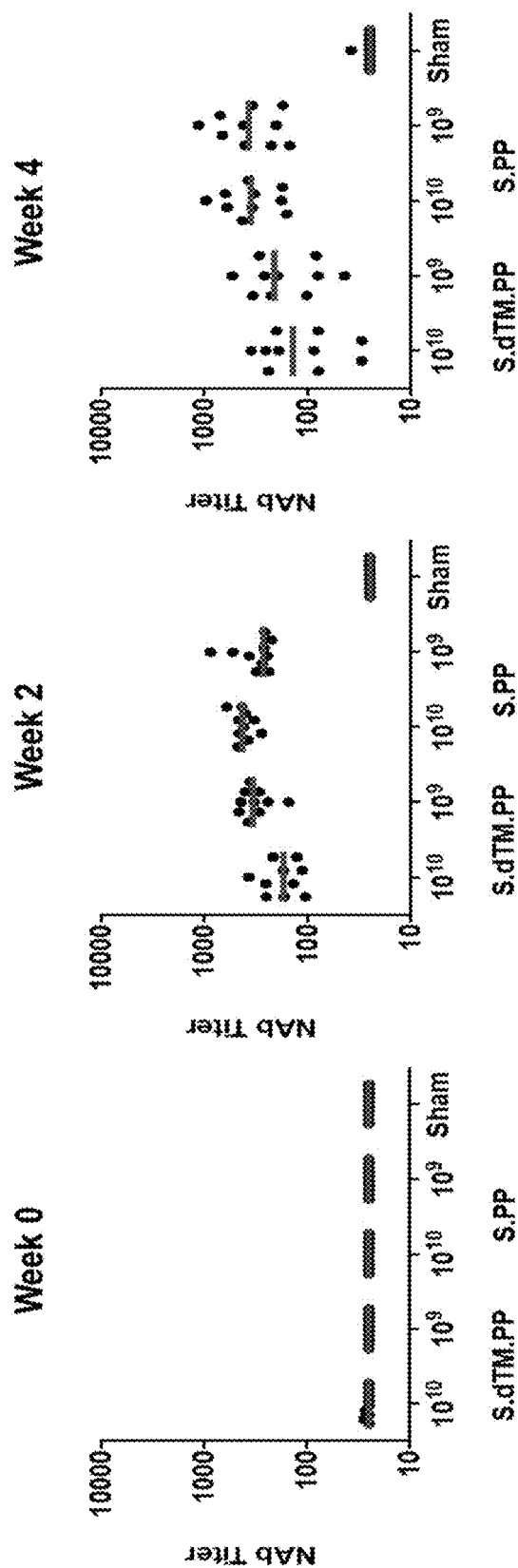

We produced recombinant, replication-incompetent Ad26 vectors encoding (i) SARS CoV-2 spike (S) with deletion of the transmembrane region and cytoplasmic tail reflecting the soluble ectodomain with a foldon trimerization domain (S.dTM.PP) or (ii) full-length S (S.PP), both with mutation of the furin cleavage site and two proline stabilizing mutations (FIG. 98A).

In Example 20 the immunogenicity and protective efficacy of the S.PP vaccine against SARS-CoV-2 challenge in rhesus macaques was described.

In this example 50 Syrian golden hamsters were immunized with $10^{10}$ or $10^9$ viral particles (vp) Ad26 vectors encoding S.dTM.PP or S.PP (N=10/group) or sham controls (N=10). Animals received a single vaccination by the intramuscular route at week 0. We observed receptor binding domain (RBD)-specific binding antibodies by ELISA (FIG. 98B) and neutralizing antibodies (NAbs) by a pseudovirus neutralization assay (FIG. 98C) in all animals at week 2 and week 4. At week 4, Ad26-S.PP elicited 4.0-4.7 fold higher median ELISA titers (4470, 4757) compared with Ad26-S.dTM.PP (1014, 1185) (FIG. 98B; P<0.0001, two-sided Mann-Whitney tests). Similarly, Ad26-S.PP elicited 1.8-2.6 fold higher median NAb IC50 titers (359, 375) compared with Ad26-S.dTM.PP (139, 211) (P<0.05, two-sided Mann-Whitney tests). For each vector, the two doses tested appeared comparable. ELISA and NAb data were correlated at both week 2 and week 4 (R=0.7074, P<0.0001 and R=0.7849, P<0.0001, respectively, two-sided Spearman rank correlation tests).

Figure 98D:
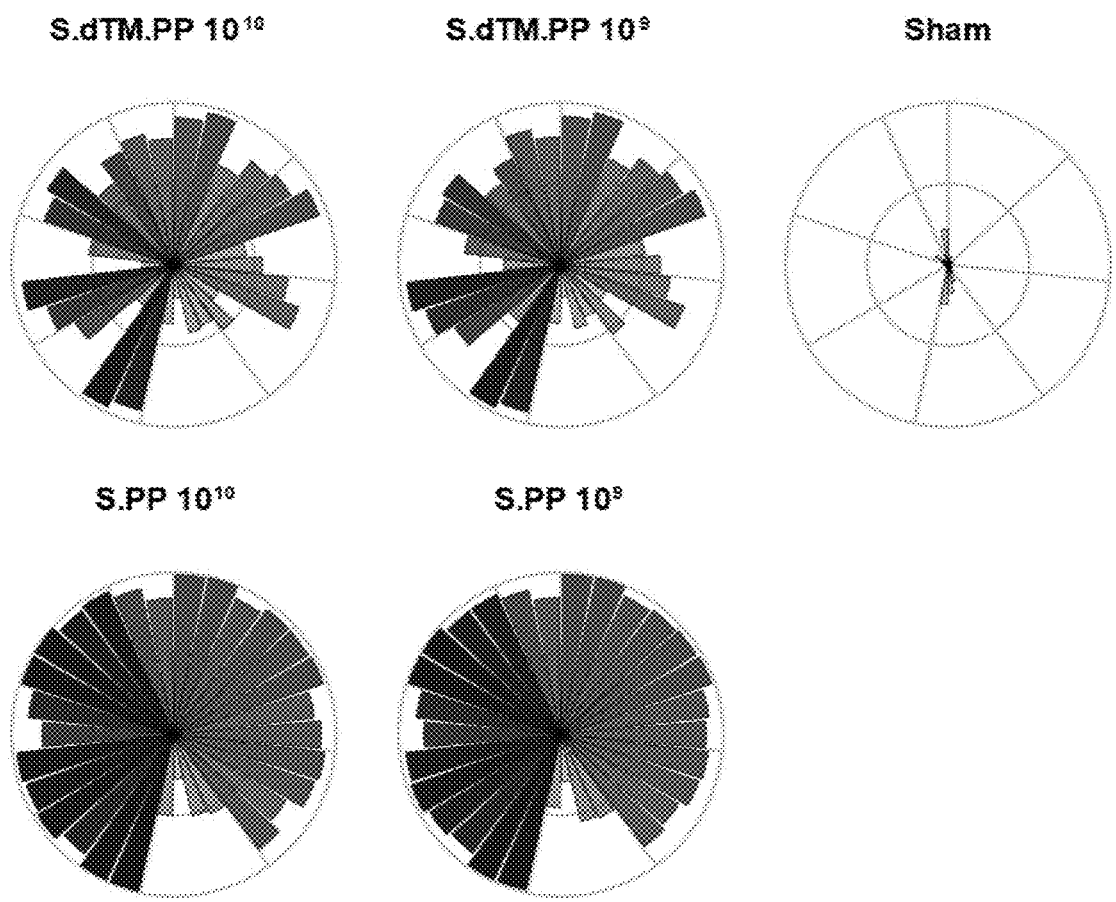
Figure 98E:
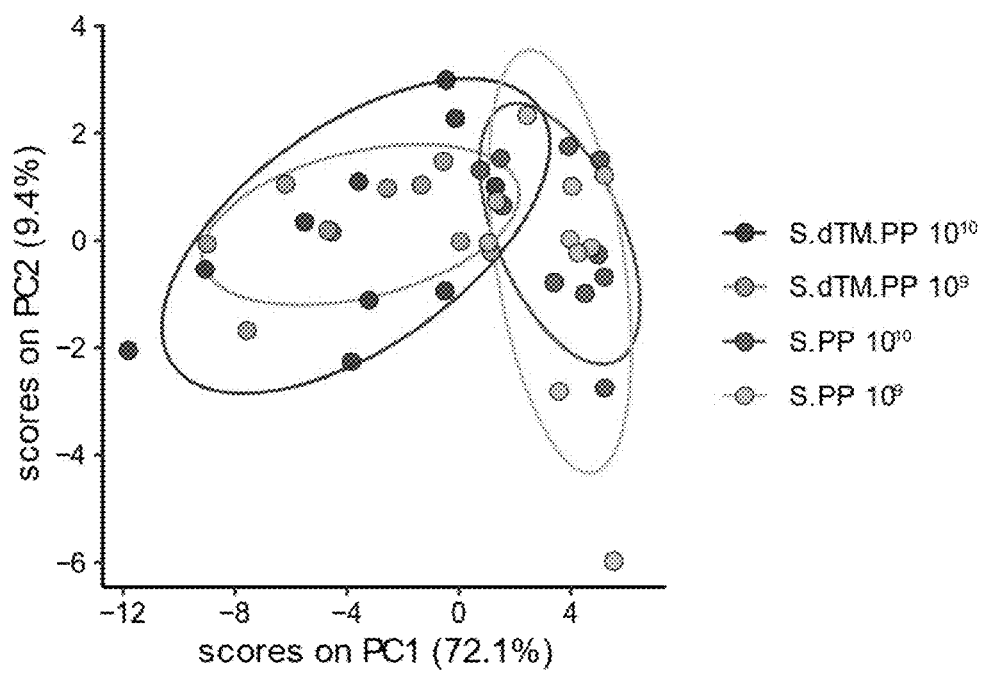
Figure 98F:
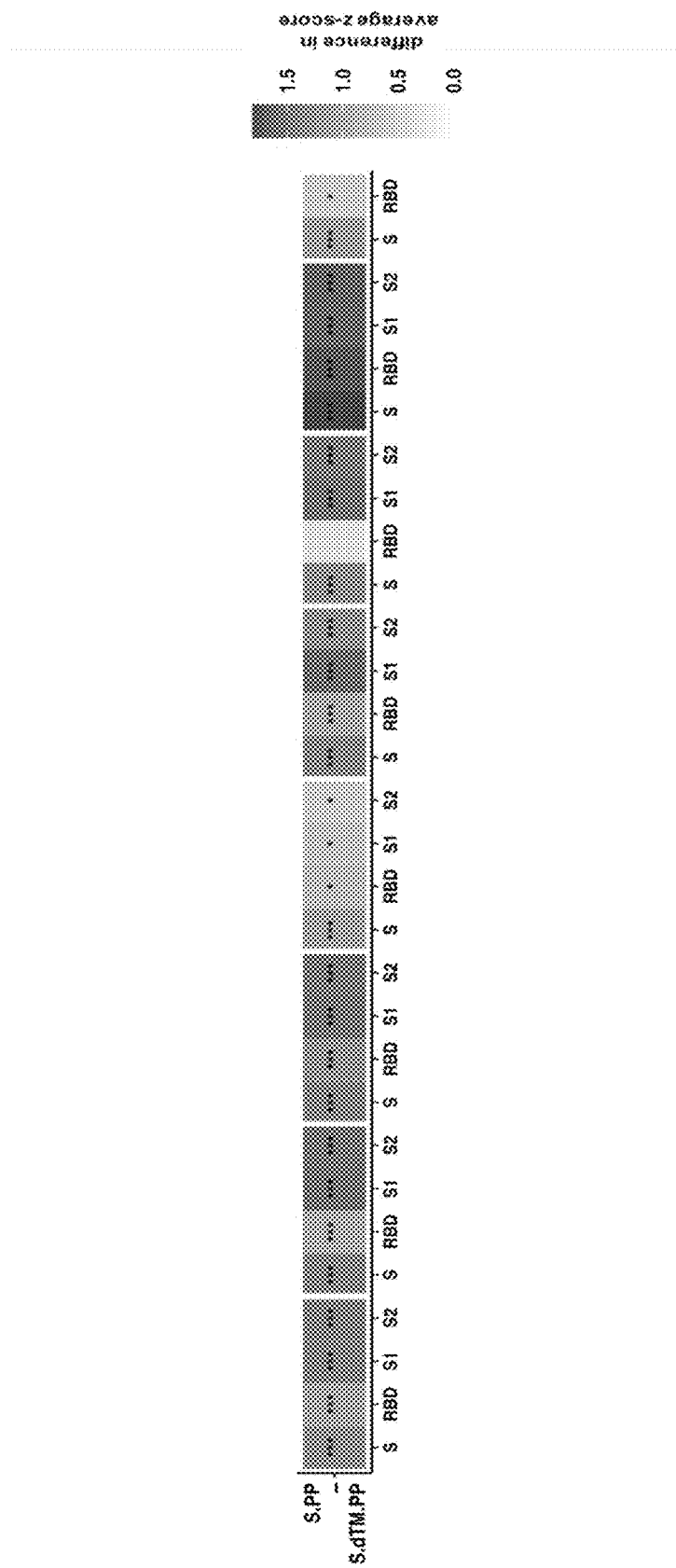

We further characterized S-specific and RBD-specific antibody responses in the vaccinated animals at week 4 by systems serology (Chung, et al., Cell 163, 988-998, doi: 10.1016/j.cell.2015.10.027 (2015)). IgG, IgG2a, IgG3, IgM, Fc-receptors FcRγ2, FcRγ3, and FcRγ4, and antibody-dependent complement deposition (ADCD) responses were assessed (FIGS. 98D-98F). Higher and more consistent responses were observed with Ad26-S.PP compared with Ad26.S.dTM.PP (FIG. 98D, 98F), and a principal component analysis of these antibody features confirmed that these two vaccines had distinct profiles (FIG. 98E).

At week 4, all animals were challenged with $5 \times 10^5$ TCID$_{50}$ SARS-CoV-2 by the intranasal route. Three animals in each group were necropsied on day 4 for tissue viral loads and histopathology, and the remaining 7 animals in each group were followed until day 14. In the sham controls, hamsters lost a median of 19.6% of body weight by day 7, and 43% (3 of 7) of the animals that were followed longitudinally met euthanasia criteria on day 6-7 (FIG. 99A, 99B). The Ad26-S.dTM.PP vaccinated animals lost a median of 8.7% body weight, and the Ad26-S.PP vaccinated animals lost a median of 4.0% body weight (FIG. 99A, 99B). Maximum percent weight loss was markedly lower in both vaccinated groups compared with sham controls (P<0.0001, two-sided Mann-Whitney tests; FIG. 99C), and animals that received Ad26-S.PP showed less weight loss than animals that received Ad26.S.dTM.PP (P<0.0001, two-sided Mann-Whitney tests; FIG. 99C). Both vaccines protected against mortality, defined as meeting humane euthanization criteria, as compared with sham controls (P=0.02, two-sided Fisher's exact tests). A combined analysis of the two hamster experiments confirmed that both vaccines effectively protected against mortality (P=0.007, two-sided Fisher's exact tests). ELISA responses at week 2 (R=−0.8992, P<0.0001) and week 4 (R=−0.9344, P<0.0001) correlated inversely with maximum percent weight loss. NAb responses at week 2 (R=−0.7380, P<0.0001) and week 4 (R=−0.8075, P<0.0001) also correlated inversely with maximum percent weight loss. Histiocytic and neutrophilic inflammatory infiltrates were markedly reduced in all lung lobes, and significantly reduced SARS-CoV-2 vRNA was observed in Ad26-S.dTM.PP and Ad26-S.PP vaccinated hamsters compared with sham controls (P=0.004 and P=0.004, respectively, two sided Mann-Whitney tests).

In this Example it is demonstrated that a single immunization of an Ad26 vector encoding a full-length prefusion stabilized S immunogen (S.PP) protected against severe clinical disease following high-dose SARS-CoV-2 challenge in hamsters. Sham controls demonstrated marked weight loss, severe pneumonia, and partial mortality. In contrast, vaccinated animals showed minimal weight loss and pneumonia and no mortality. Vaccine-elicited binding and neutralizing antibody responses correlated with protection against clinical disease as well as reduced virus replication in the upper and lower respiratory tract.

This severity of clinical disease in this model contrasts with prior studies involving SARS-CoV-2 infection in hamsters and other species. Hamsters are a permissive model for SARS-CoV-2 as a result of their homology to the human ACE2 receptor, and transmission among hamsters has been reported (Sia, et al., Nature, doi:10.1038/s41586-020-2342-5 (2020)). The high challenge dose resulted in extensive clinical disease in the present study, although biologic factors that remain to be fully defined may also impact clinical disease, such as animal age, animal origin, and viral challenge stock.

SARS-CoV-2 vaccine studies in nonhuman primates have to date demonstrated protection against infection or reduction of viral replication in the upper and lower respiratory tracts. In Example 20 it was reported that a single immunization of Ad26-S.PP provided complete or near-complete protection against SARS-CoV-2 challenge in rhesus macaques. However, SARS-CoV-2 infection in nonhuman primates does not result in severe clinical disease or mortality. A severe disease model thus would be useful to complement current nonhuman primate challenge models, since protection against viral replication does not necessarily imply protection against severe disease. Indeed, in the histopathologic analysis of hamsters in the present study, viral loads in lung decreased from day 2 to day 7, whereas inflammatory markers continued to escalate during this time period and correlated with continued weight loss. These data suggest that progressive clinical disease in hamsters is primarily an inflammatory process, which is triggered by infection but continued to increase even when viral replication decreased. Because COVID-19 in humans can progress to severe clinical disease, it is important to test SARS-CoV-2 vaccine candidates in preclinical models that recapitulate severe clinical disease, including fulminant pneumonia and mortality. The high-dose hamster model described in this Example achieves many of these criteria and therefore may be useful to study the pathogenesis of severe disease and to test countermeasures. The primary manifestation of clinical disease in this model was severe pneumonia, rather than encephalitis that has been reported in certain hACE2 transgenic mouse models. Moreover, binding and neutralizing antibody responses correlated with protection.

In summary, these data demonstrate that a single immunization of Ad26-S.PP provides robust protection against severe clinical disease following high-dose SARS-CoV-2 infection in hamsters. To the best of our knowledge, vaccine protection against severe SARS-CoV-2 pneumonia and mortality has not previously been reported. Ad26-S.PP, which is also termed Ad26.COV2.S, is currently being evaluated in clinical trials. This hamster severe disease model should prove useful for testing of SARS-CoV-2 vaccines, therapeutics, and other countermeasures.

Methods

Animals and study design. 70 male and female Syrian golden hamsters (Envigo), 10-12 weeks old were randomly allocated to groups. All animals were housed at Bioqual, Inc. (Rockville, Md.). Animals received Ad26 vectors expressing S.dTM.PP or S.PP or sham controls (N=10/group). Animals received a single immunization of $10^{10}$ or $10^9$ viral particles (vp) Ad26 vectors by the intramuscular route without adjuvant at week 0. At week 4, all animals were challenged with $5.0 \times 10^5$ TCID$_{50}$ ($6 \times 10^8$ VP, $5.5 \times 10^4$ PFU) or $5.0 \times 10^4$ TCID$_{50}$ ($6 \times 10^7$ VP, $5.5 \times 10^3$ PFU) SARS-CoV-2, which was derived with 1 passage from USA-WA1/2020 (NR52281; BEI Resources). Virus was administered as 100 µL by the intranasal (IN) route (50 µL in each nare). Body weights were assessed daily. All immunologic and virologic assays were performed blinded. On day 4, a subset of animals was euthanized for tissue viral loads and pathology. All animal studies were conducted in compliance with all relevant local, state, and federal regulations and were approved by the Bioqual Institutional Animal Care and Use Committee (IACUC).

Ad26 vectors. Ad26 vectors were constructed with two variants of the SARS-CoV-2 spike (S) protein sequence (Wuhan/WIV04/2019; Genbank MN996528.1). Sequences were codon optimized and synthesized. Replication-incompetent, E1/E3-deleted Ad26-vectors were produced in PER.C6.TetR cells using a plasmid containing the full Ad26 vector genome and a transgene expression cassette. Sham controls included Ad26-Empty vectors. Vectors were sequenced and tested for expression prior to use.

Histopathology and immunohistochemistry. Tissues were fixed in freshly prepared 4% paraformaldehyde for 24 h, transferred to 70% ethanol, paraffin embedded within 7-10 days, and blocks sectioned at 5 µm. Slides were baked for 30-60 min at 65° C. then deparaffinized in xylene and rehydrated through a series of graded ethanol to distilled water. For SARS-CoV-N, Iba-1, and CD3 IHC, heat induced epitope retrieval (HIER) was performed using a pressure cooker on steam setting for 25 min in citrate buffer (Thermo; AP-9003-500) followed by treatment with 3% hydrogen peroxide. Slides were then rinsed in distilled water and protein blocked (BioCare, BE965H) for 15 min followed by rinses in 1× phosphate buffered saline. Primary rabbit anti-SARS-CoV-nucleoprotein antibody (Novus; NB100-56576 at 1:500 or 1:1000), rabbit anti-Iba-1 antibody (Wako; 019-19741 at 1:500), or rabbit anti-CD3 (Dako; A0452 at 1:300) was applied for 30 minutes followed by rabbit Mach-2 HRP-Polymer (BioCare; RHRP520L) for 30 min then counterstained with hematoxylin followed by bluing using 0.25% ammonia water. Labeling for SARS-CoV-N, Iba-1, and CD3 were performed on a Biogenex 16000 Autostainer (v3.02). In some cases, CD3, Iba-1, and ACE-2 staining was performed with CD3 at 1:400 (Thermo Cat. No. RM-9107-S; clone SP7), Iba-1 at 1:500 (BioCare Cat. No. CP290A; polyclonal), or ACE-2 (Abcam; ab108252), all of which were detected by using Rabbit Polink-1 HRP (GBI Labs Cat. No. D13-110). Neutrophil (MPO) and type 1 IFN response (Mx1) was performed with MPO (Dako Cat. No. A0398; polyclonal) at 1:1000 detection using Rabbit Polink-1 HRP, and Mx1 (EMD Millipore Cat. No. MABF938; clone M143/CL143) at 1:1000 detection using Mouse Polink-2 HRP (GBI Labs Cat. No. D37-110). Staining for CD3, Iba-1, MPO, and Mx1 IHC was performed as previously described using a Biocare intelliPATH autostainer, with all antibodies being incubated for 1 h at room temperature. Tissue pathology was assessed independently by two veterinary pathologists.

RNAscope in situ hybridization. RNAscope in situ hybridization was performed as previously described (Chandrashekar, A. et al., Science, doi:10.1126/science.abc4776 (2020)) using SARS-CoV2 anti-sense specific probe v-nCoV2019-S (ACD Cat. No. 848561) targeting the positive-sense viral RNA and SARS-CoV-2 sense specific probe vnCoV2019-orf1ab-sense (ACD Cat. No. 859151) targeting the negative-sense genomic viral RNA. In brief, after slides were deparaffinized in xylene and rehydrated through a series of graded ethanol to distilled water, retrieval was performed for 30 min in ACD P2 retrieval buffer (ACD Cat. No. 322000) at 95-98° C., followed by treatment with protease III (ACD Cat. No. 322337) diluted 1:10 in PBS for 20 min at 40° C. Slides were then incubated with 3% H2O2 in PBS for 10 min at room temperature. Prior to hybridization, probes stocks were centrifuged at 13,000 rpm using a microcentrifuge for 10 min, then diluted 1:2 in probe diluent (ACD Cat. No. 300041) to reduce probe aggregation tissue artifacts. Slides were developed using the RNAscope® 2.5 HD Detection Reagents-RED (ACD Cat. No. 322360).

Quantitative image analysis. Quantitative image analysis was performed using HALO software (v2.3.2089.27 or v3.0.311.405; Indica Labs) on at least one lung lobe cross section from each animal. In cases where >1 cross-section was available, each lung lobe was quantified as an individual data point. For SARS-CoV-N the Multiplex IHC v2.3.4 algorithm was used with an exclusion screen for acid hematin to determine the percentage of SAR-N protein positive cells as a proportion of the total number of cells. For Iba-1, the Multiplex IHC v2.3.4 algorithm was used for quantitation. For SARS-CoV-2 RNAscope ISH and Mx1 quantification, the Area Quantification v2.1.3 module was used to determine the percentage of total SARS-CoV-2 antisense or sense probe, or Mx1 protein as a proportion of the total tissue area. For MPO (neutrophil) and CD3+ cell quantification, slides were annotated to exclude blood vessels (>5 mm$^2$), bronchi, bronchioles, cartilage, and connective tissue; subsequently, the Cytonuclear v1.6 module was used to detect MPO+ or CD3+ cells and calculated as a proportion of total alveolar tissue (PMNs/mm$^2$), which was determined by running the Area Quantification v2.1.3 21 module. In all instances, manual inspection of all images was performed on each ample to ensure the annotations were accurate.

Subgenomic mRNA assay. SARS-CoV-2 E gene subgenomic mRNA (sgmRNA) was assessed by RT-PCR using primers and probes as previously described[10,11,23]. Briefly, total RNA was extracted from tissue homogenates from several anatomical sites using a QIAcube HT (Qiagen) and RNeasy 96 QIAcube HT Kit (Qiagen). A standard curve was generated using the SARS-CoV-2 E gene sgmRNA by cloning into a pcDNA3.1 expression plasmid; this insert was transcribed using an AmpliCap-Max T7 High Yield Message Maker Kit (Cellscript). Prior to RT-PCR, samples collected from challenged animals or standards were reverse-transcribed using Superscript III VILO (Invitrogen) according to the manufacturer's instructions. A Taqman custom gene expression assay (ThermoFisher Scientific) was designed using the sequences targeting the E gene sgmRNA. Reactions were carried out on QuantStudio 6 and 7 Flex Real-Time PCR Systems (Applied Biosystems) according to the manufacturer's specifications. Standard curves were used to calculate sgmRNA copies per gram tissue; the quantitative assay sensitivity was 100 copies.

ELISA. RBD-specific binding antibodies were assessed by ELISA essentially as described (Chandrashekar, et al., Science, doi:10.1126/science.abc4776 (2020); Yu, et al., Science, doi:10.1126/science.abc6284 (2020))[10,11]. Briefly, 96-well plates were coated with 1 μg/ml SARS-CoV-2 RBD protein (Aaron Schmidt, MassCPR) or 1 μg/ml SARS-CoV-2 spike (S) protein (Sino Biological) in 1×DPBS and incubated at 4° C. overnight. After incubation, plates were washed once with wash buffer (0.05% Tween20 in 1×DPBS) and blocked with 350 μL casein block/well for 2-3 h at room temperature. After incubation, block solution was discarded and plates were blotted dry.

Threefold serial dilutions of heat-inactivated serum in casein block were added to wells and plates were incubated for 1 h at room temperature, plates were washed three times then subsequently incubated for 1 h with 0.1 μg/mL of anti-hamster IgG HRP (Southern Biotech) in casein block, at room temperature in the dark. Plates were washed three times, then 100 μL of SeraCare KPL TMB SureBlue Start solution was added to each well; plate development was halted by the addition of 100 μL SeraCare KPL TMB Stop solution per well. The absorbance at 450 nm was recorded using a VersaMax or Omega microplate reader. ELISA endpoint titers were defined as the highest reciprocal serum dilution that yielded an absorbance 2-fold above background.

Pseudovirus neutralization assay. The SARS-CoV-2 pseudoviruses expressing a luciferase reporter gene were generated in an approach similar to as described previously[10,11,21]. Briefly, the packaging construct psPAX2 (AIDS Resource and Reagent Program), luciferase reporter plasmid pLenti-CMV Puro-Luc (Addgene), and spike protein expressing pcDNA3.1-SARS CoV-2 SΔCT were co-transfected into HEK293T cells by lipofectamine 2000 (ThermoFisher). The supernatants containing the pseudotype viruses were collected 48 h post transfection; pseudotype viruses were purified by filtration with 0.45 μm filter. To determine the neutralization activity of the antisera from vaccinated animals, HEK293T-hACE2 cells were seeded in 96-well tissue culture plates at a density of $1.75 \times 10^4$ 293 cells/well overnight. Three-fold serial dilutions of heat inactivated serum samples were prepared and mixed with 50 μL of pseudovirus. The mixture was incubated at 37° C. for 1 h before adding to HEK293T-ACE2 cells. 48 h after infection, cells were lysed in Steady-Glo Luciferase Assay (Promega) according to the manufacturer's instructions. SARS-CoV-2 neutralization titers were defined as the sample dilution at which a 50% reduction in RLU was observed relative to the average of the virus control wells.

Luminex. In order to detect relative quantity of antigen-specific antibody titers, a customized Luminex assay was performed as previously described25. Hereby, fluorescently labeled microspheres (Luminex) were coupled with SARS-CoV-2 antigens including spike protein (S) (Eric Fischer, Dana Farber Cancer Institute), S1 and S2 (Sino Biological), as well as Receptor Binding Domain (RBD) (Aaron Schmidt, Ragon Institute) via covalent N505 hydroxysuccinimide (NHS)-ester linkages via EDC (Thermo Scientific) and Sulfo-NHS (Thermo Scientific). $1.2 \times 10^3$ 506 beads per region and antigen were added to a 384-well plate (Greiner) and incubated with diluted serum (1:90 for IgG2a, IgG3, IgM; 1:500 for total IgG and Fc-receptor binding assays) for 16 h shaking at 900 rpm at 4° C. Following formation of immune complexes, microspheres were washed three times in 0.1% BSA and 0.05% Tween-20 (Luminex assay buffer) using an automated plate washer (Tecan). PE-labeled goat anti-mouse IgG, IgG2a, IgG3, and IgM detection antibodies (southern biotech) were diluted in Luminex assay buffer to 0.65 ug/ml and incubated with beads for 1 h at RT while shaking at 900 rpm. Similarly, for the Fc-receptor binding profiles, recombinant mouse FcγR2, FcγR3 and FcγR4 (Duke Protein Production facility) were biotinylated (Thermo Scientific) and conjugated to Streptavidin-PE for 10 min prior to addition to samples (Southern Biotech). These mouse antibodies and proteins are cross-reactive to hamster. The coated beads were then washed and read on a flow cytometer, iQue (Intellicyt) with a robot arm attached (PAA). Events were gated on each bead region, median fluorescence of PE for of bead positive events was reported. Samples were run in duplicate per each secondary detection agent.

Antibody-dependent complement deposition (ADCD). ADCD assays were performed as previously described[26]. Briefly, SARS-CoV-2 S and RBD were biotinylated (Thermo Fisher) and coupled to 1 μm red fluorescent neutravidin-beads (Thermo Fisher) for 2 h at 37° C., excess antigen was washed away afterwards. For the formation of immune complexes, $1.82 \times 10^8$ antigen-coated beads were added to each well of a 96-well round bottom plate and incubated with 1:10 diluted samples at 37° C. for 2 h. Lyophilized guinea pig complement was reconstituted according to manufacturer's instructions (Cedarlane) with water and 4 μl per well were added in gelatin veronal buffer containing Mg2+ and Ca2+(GVB++, Boston BioProducts) to the immune complexes for 20 min at 37° C. Immune complexes were washed with 15 mM EDTA in PBS, and fluorescein-conjugated goat IgG fraction to guinea pig complement C3 (MpBio) was added. Post staining, samples were fixed with 4% paraformaldehyde (PFA) and sample acquisition was performed via flow cytometry (Intellicyt, iQue Screener plus) utilizing a robot arm (PAA). All events were gated on single cells and bead positive events, the median of C3 positive events is reported. All samples were run in duplicate on separate days.

Statistical analysis. Analysis of immunologic, virologic, and body weight data was performed using GraphPad Prism 8.4.2 (GraphPad Software). Comparison of data between groups was performed using two-sided Mann-Whitney tests. Mortality was assessed by two sided Fisher's exact tests. Correlations were assessed by two-sided Spearman rank-correlation tests. P-values of less than 0.05 were considered significant. All systems serology data were log 10 transformed. For the radar plots, each antibody feature was normalized such that its minimal value is 0 and the maximal value is 1 across groups before using the median within a group. A principal component analysis (PCA) was constructed using the R version 3.6.1 package 'ropls' to compare multivariate profiles. For the visualization in the heatmap, the differences in the means of the S.dTM.PP and S.PP groups of z-scored features were shown. To indicate significances in the heatmaps, a Benjamini-Hochberg correction was used to correct for multiple comparisons within a row.

Example 22: A Randomized, Double-Blind, Placebo-Controlled Phase 3 Study to Assess the Efficacy and Safety of Ad26.COV2.S for the Prevention of SARS-CoV-2-Mediated COVID-19 in Adults Aged 18 Years and Older A Randomized, Double-blind, Placebo-controlled Phase 3 Study to Assess the Efficacy and Safety of Ad26.COV2.S for the Prevention of SARS-CoV-2-mediated COVID-19 in Adults Aged 18 Years and Older is performed.

Ad26.COV2.S is a monovalent vaccine composed of a recombinant, replication-incompetent adenovirus type 26 (Ad26) vector, constructed to encode the severe acute respiratory syndrome coronavirus-2 (SARS-CoV-2) spike (S) protein, as described herein.

This is a multicenter, randomized, double-blind, placebo-controlled, Phase 3, pivotal efficacy and safety study in adults years of age. The efficacy, safety, and immunogenicity of Ad26.COV2.S will be evaluated in participants with higher risk for COVID-19 (based on age, gender, race/ethnicity, profession, comorbidity) living in, or going to, locations with high SARS-CoV-2 activity, after administration of 2 doses of study vaccine.

Participants will be randomized in parallel in a 1:1 ratio to receive intramuscular (IM) injections of Ad26.COV2.S or placebo as shown in the table below. Ad26.COV2.S will be administered at a dose level of $1\times10^{11}$ virus particles (vp), or at a dose level of $1\times10^{10}$ in a one or two dose schedule.

It is intended that a minimum of approximately 25% of recruited participants will be 60 years of age and a maximum of approximately 25% of recruited participants will be ≥18 to <40 years of age A staggered enrollment strategy will be used:
Stage 1: Initially, 1,000 participants without comorbidities that are associated with increased risk of progression to severe COVID-19 (including 500 Ad26.COV2.S recipients and 500 placebo recipients; equally distributed between age groups) will be enrolled in 2 age-dependent subgroups (≥18 years to <60 years of age in Stage 1a and ≥60 years of age in Stage 1b), based on acceptable Day 29 safety and adequate immunogenicity data, including T-helper 1/T-helper 2 (Th1/Th2), from the corresponding age groups of the first-in-human (FIH) study VAC31518COV1001 (see body of this document for more details).
Stage 2: After a vaccination pause in Stage 1 to allow the Independent Data Monitoring Committee (IDMC, also known as an Data Safety Monitoring Board [DSMB]) to examine 3-day safety data (consisting of all Grade 4 AEs and all SAEs), if no safety concerns are identified enrollment will proceed, expanding enrollment to include participants with comorbidities that are associated with increased risk of progression to severe COVID-19 in 2 age-dependent subgroups (≥18 years to <60 years of age in Stage 2a and ≥60 years of age in Stage 2b). Comorbidities (or risk factors) that are or might be associated with an increased risk of progression to severe COVID-19 include: moderate-to-severe asthma; chronic lung diseases such as chronic obstructive pulmonary disease (COPD) (including emphysema and chronic bronchitis), idiopathic pulmonary fibrosis and cystic fibrosis; diabetes (including type 1, type 2, or gestational); serious heart conditions, including heart failure, coronary artery disease, congenital heart disease, cardiomyopathies, and (pulmonary) hypertension or high blood pressure; obesity (body mass index [BMI]≥30 kg/m2); chronic liver disease, including cirrhosis; sickle cell disease; thalassemia; cerebrovascular disease; neurologic conditions (dementia); end stage renal disease; organ transplantation; cancer; human immunodeficiency virus (HIV) infection and other immunodeficiencies hepatitis B infection; sleep apnea; Parkinson's disease; seizures; ischemic strokes; Intracranial hemorrhage; Guillain-Barré syndrome; encephalopathy; meningoencephalitis; and participants who live in nursing homes or long-term care facilities. For details and exceptions, refer to the exclusion criteria in this document.

The duration of individual participation, including screening, will be maximum 2 years and 3 months. If a participant is unable to complete the study, but has not withdrawn consent, an early exit visit will be conducted. The end-of-study is considered as the completion of the last visit for the last participant in the study.

Key efficacy assessments include the surveillance for COVID-19-like signs and symptoms, recording of COVID-19-related hospitalizations and complications, and the laboratory confirmation of SARS-CoV-2 infection by a molecular assay (based on RT-PCR) and by anti-SARS-CoV-2 serology. Immunogenicity assessments, and especially assessments of the humoral immune responses with emphasis on neutralizing and binding antibodies will also be performed. Key safety assessments will include the monitoring of solicited and unsolicited AEs (in the Safety Subset only), and the collection of SAEs and MAAEs in all participants. The viral load of SARS-CoV-2 will be assessed in confirmed COVID-19 cases. Biomarkers correlating with SARS-CoV-2 infection and COVID-19 severity will also be studied. Medical resource utilization (MRU) following vaccination will be recorded for all participants with molecularly confirmed, symptomatic COVID-19. At selected sites, additional baseline characteristics related to current work situation, living situation, and community interactions may be collected for covariate analyses, if allowed per local regulations.

Until 1 year after the 2nd vaccination, each participant will be asked at least twice a week, through the electronic clinical outcome assessment (eCOA), if they have experienced any new symptoms or health concerns that could be related to infection with SARS-CoV-2. As of 1 year after the 2nd vaccination, until the end of the 2-year follow-up period, the frequency of this surveillance question through the eCOA will decrease to once every 2 weeks. All participants remain to be monitored for enhanced disease until the last study visit. For all participants that are lost to follow-up through eCOA and hospitalization has not been recorded, every effort will be made to document their status.

All participants with COVID-19-like signs or symptoms meeting the prespecified criteria for suspected COVID-19 on COVID-19 Day 1-2 and Day 3-5 should undertake the COVID-19 procedures (as described in body of this protocol) until 14 days after symptom onset (COVID-19 Day 15) or until resolution of the COVID-19 episode, whichever comes last, unless it is confirmed that both nasal swabs collected on COVID-19 Day 1-2 and Day 3-5 are negative for SARS-CoV-2. Resolution of the COVID-19 episode is defined as having 2 consecutive SARS-CoV-2 negative nasal swabs and 2 consecutive days with no COVID-19-related signs or symptoms. At the time of resolution of the COVID-19 episode, the collected information will be applied against the clinical case definition.

All necessary precautions (as per local regulation) should be taken to protect medical staff and other contacts of participants who are suspected to have COVID-19 until proven negative by molecular techniques or who are positive AND meet the prespecified criteria for suspected COVID-19 on COVID-19 Day 1-2 and Day 3-5 until they are no longer positive. In the event of a confirmed SARS-CoV-2 infection, the participant and participant's medical care provider and/or local health authorities (if required) will be notified, and the participant will be asked to adhere to the appropriate measures and restrictions as defined by local regulations.

Case Definition for Moderate to Severe COVID-19

For the primary endpoint, all moderate and severe/critical COVID-19 cases will be considered.

Case Definition for Moderate COVID-19

A SARS-CoV-2 positive RT-PCR or molecular test result from any available respiratory tract sample (e.g., nasal swab sample, sputum sample, throat swab sample, saliva sample) or other sample AND at any Time During the Course of Observation:
Shortness of breath (difficulty breathing)
OR
Any 1 of the following new or worsening signs AND any 1 of the following new or worsening symptoms:

| Signs | Symptoms |
| --- | --- |
| Respiratory rate ≥ 20 breaths/minute | Fever (≥38.0° C. or 100.4° F.) |
| Abnormal saturation of oxygen (SpO$_2$) but still > 93% on room air at sea level* | Cough |
| Heart rate ≥ 90 beats/minute | Sore throat |
| Clinical or radiologic evidence of pneumonia | Malaise as evidenced by 1 or more of the following: Loss of appetite Generally unwell Fatigue Physical weakness |
| Radiologic evidence of deep vein thrombosis (DVT) | Headache Muscle pain (myalgia) Gastrointestinal symptoms (diarrhea, vomiting, nausea, abdominal pain) |

*SpO$_2$ criteria will be adjusted according to altitude.

OR
Any 2 of the following new or worsening symptoms:
Fever (≥38.0° C. or ≥100.4° F.)
Shaking chills or rigors
Cough
Sore throat
Malaise as evidenced by 1 or more of the following elements*:
  loss of appetite
  generally unwell
  fatigue
  physical weakness
Headache
Muscle pain (myalgia)
Gastrointestinal symptoms as evidenced by 1 or more of the following elements*:
  diarrhea
  vomiting
  nausea
  abdominal pain
Red or bruised looking feet or toes
New or changing olfactory or taste disorders
*Having 2 or more elements of a symptom (eg, vomiting and diarrhea or fatigue and loss of appetite) is counted only as 1 symptom for the case definition. To meet the case definition, a participant would need to have at least 2 different symptoms.

Case Definition for Severe/Critical COVID-19

A SARS-CoV-2 positive RT-PCR or molecular test result from any available respiratory tract sample (e.g., nasal swab sample, sputum sample, throat swab sample, saliva sample) or other sample AND any 1 of the Following at any Time During the Course of Observation:

Clinical signs at rest indicative of severe systemic illness (respiratory rate ≥30 breaths/minute, heart rate ≥125 beats/minute, oxygen saturation (SpO2) ≤93% on room air at sea level*, or partial pressure of oxygen/fraction of inspired oxygen (PaO2/FiO2)<300 mmHg)

* SpO$_2$ criteria will be adjusted according to altitude.

Respiratory failure (defined as needing high-flow oxygen, non-invasive ventilation, mechanical ventilation, or extracorporeal membrane oxygenation [ECMO])

Evidence of shock (defined as systolic blood pressure <90 mmHg, diastolic blood pressure <60 mmHg, or requiring vasopressors)

Significant acute renal, hepatic, or neurologic dysfunction
Admission to the ICU
Death Case Definition for Mild COVID-19

A SARS-CoV-2 positive RT-PCR or molecular test result from any available respiratory tract sample (eg, nasal swab sample, sputum sample, throat swab sample, saliva sample) or other sample;

AND at any Time During the Course of Observation:

One of the following symptoms: fever (≥38.0° C. or ≥100.4° F.), sore throat, malaise (loss of appetite, generally unwell, fatigue, physical weakness), headache, muscle pain (myalgia), gastrointestinal symptoms, cough, chest congestion, runny nose, wheezing, skin rash, eye irritation or discharge, chills, or new loss of taste or smell.

A case is considered clinically mild when it meets the above case definition but not the moderate to severe/critical definition.

Example 23. A Randomized, Double-Blind, Placebo-Controlled, First-In-Human (FIH) Phase 1/2a Multicenter Study in Adults Aged ≥18 to ≤55 Years and Aged ≥65 Years Evaluating the Safety, Reactogenicity, and Immunogenicity of Ad26.COV2.S A phase 1/2a randomized, double-blinded, placebo-controlled clinical study was designed that assesses the safety, reactogenicity and immunogenicity of Ad26.COV2.S, a non-replicating adenovirus 26 based vector expressing the stabilized pre-fusion spike (S) protein of SARS-CoV-2, according to the invention, administered at a dose level of $5 \times 10^{10}$ or $1 \times 10^{11}$ viral particles (vp) per vaccination, either as a single dose or as a two-dose schedule spaced by 56 days in healthy adults (18-55 years old; cohort 1a; n=377) and healthy elderly (>65 years old; cohort 3; n=394). Vaccine elicited S specific antibody levels were measured by ELISA, neutralizing titers were measured in a wild-type virus neutralization assay (wtVNA). Th1 and Th2 were assessed by intracellular cytokine staining (ICS).

Methods

Study Design and Participants

The study is a multi-center, randomized, double-blind, placebo-controlled trial to evaluate safety, reactogenicity, and immunogenicity of Ad26.COV2.S at $5 \times 10^{10}$ vp or $1 \times 10^{11}$ vp, administered intramuscularly (IM) as single-dose or two-dose schedules, 8 weeks apart, in healthy adults 18-55 and >65 years of age. Overview of the clinical trial is given in FIG. 101.

Ad26.COV2.S is a recombinant, replication-incompetent Ad26 vector encoding an engineered version of the SARS-CoV-2 S protein derived from the first clinical isolate of the Wuhan strain (Wuhan, 2019, whole genome sequence NC_045512), as described herein. The study was performed at multiple clinical sites in Belgium and US. All subjects were screened for COVID-19 by collection of nasal samples for PCR, which if positive would exclude them and by locally available serological assays for detection of previous infection with SARS, -CoV-2 with a maximum of 25 seropositive participants allowed between Cohort 1a and Cohort 3. The study was reviewed and approved by the institutional review boards. All participants provided written informed consent before enrollment.

Randomization and Blinding 402 eligible participants 18-55 years of age and 405 participants >65 years of age were randomly assigned to receive one or two vaccinations with either a $5 \times 10^{10}$ or $1 \times 10^{11}$ vp dose of vaccine, or placebo (PL) (1:1:1:1 per age group): $5 \times 10^{10}$ vp/$5 \times 10^{10}$ vp; $5 \times 10^{10}$ vp/PL; $1 \times 10^{11}$ vp/$1 \times 10^{11}$ vp; $1 \times 10^{11}$ vp/PL; or PUPL (FIG. 101). Randomization was done by an Interactive Web Response System (IWRS) and stratified by site using randomly permuted blocks. Participants and investigators will remain blinded throughout the study. Vaccine and placebo were provided in masked identical syringes. Sponsor and statisticians were group-unblinded for the interim analysis when all participants completed the Day 29 visit or discontinued earlier.

Endpoints

Endpoints to support the primary objectives of safety and reactogenicity of each schedule were adverse events (AEs) for 28 days after each vaccination, local and systemic reactogenicity for 7 days after each vaccination, and serious adverse events (SAEs) throughout the study. AEs were graded according to FDA Guidance document "Toxicity Grading Scale for Healthy Adult and Adolescent Volunteers Enrolled in Preventive Vaccine Clinical Trials". The secondary endpoint was humoral immune response to the S protein of SARS-CoV-2 as demonstrated by S specific ELISA and by neutralizing titers against wild type SARS-CoV-2 in a wtVNA, and cellular immune responses as measured by ICS.

Procedures

Participants received intramuscular (IM) injections of $5 \times 10^{10}$ vp or $1 \times 10^{11}$ vp Ad26.COV2.S or placebo (0.9% saline) in a 1 mL volume in the deltoid muscle at day 1. Solicited AEs were collected on Diary cards for 7 days post vaccination, unsolicited AEs for 28 days after vaccination and SAEs throughout the course of the study. Blood samples for serum chemistry, hematology; and to determine immune readouts were and will be collected at several timepoints throughout the study; urine samples for pregnancy testing were collected before vaccination. At baseline and on day 29, Spike (S) specific binding antibodies were measured by ELISA. Seropositivity was defined as a titer >50.3 EU/mL. SARS-CoV-2 serum neutralizing antibody titers were measured in a wtVNA using the Victoria/1/2020 SARS-CoV-2 strain at Public Health England (PHE). Seropositivity in the wtVNA was defined as an IC50 titer >58. SARS-CoV-2 S specific T-cell responses were measured at baseline and on day 15 by intracellular cytokine staining (ICS) using two pools of S peptide pools of 15mers overlapping by 11. A Th1 response was characterized by CD4+ T cells expressing IFNg and/or IL-2 not IL-4, IL-5 and/or IL13 and a Th2 response was characterized by the expression of IL-4, IL-5 and/or IL-13 and CD40L by CD4+ T cells. All assays were conducted in a blinded fashion and are described below.

SARS-CoV-2 Wild-Type Virus Neutralization Assays:

Neutralizing antibodies capable of inhibiting wild type virus infections were quantified using the wild type virus microneutralization assay (MNA) that was developed and qualified by Public Health England (PHE). The virus stocks used are derived from the Victoria/1/2020 strain.

In brief, 6 two-fold serial dilutions of the heat-inactivated human serum samples were prepared in 96-well transfer plate(s). The SARS-CoV-2 wild-type virus was added sequentially to the serum dilutions at a target working concentration (approximately 100 plaque-forming units [PFU]/well) and incubated at 37° C. with 5% $CO_2$ supplementation for 60 to 90 minutes. The serum-virus mixture is then transferred onto assay plates, previously seeded overnight with Vero E6 African green monkey kidney cells and incubated at 37° C. and 5% $CO_2$ for 60 to 90 minutes before carboxymethyl cellulose (CMC) overlay medium addition and further incubation for 24 hours. Following this incubation, the cells were fixed and stained using an antibody pair specific for the SARS-CoV-2 RBD S protein and immunoplaques were visualized using TrueBlue™ substrate. Immunoplaques were counted using the Immunospot Analyzer from CTL. The immunoplaque counts were exported to SoftMaxpro and the neutralizing titer of a serum sample is calculated as the reciprocal serum dilution corresponding to the 50% neutralization antibody titer (ID50) for that sample.

Spike Enzyme-Linked Immunosorbent Assay (ELISA)

SARS-CoV-2 Pre-Spike-specific binding antibody concentrations were determined using the human SARS-CoV-2 Pre-Spike IgG ELISA, an indirect ELISA which is based on the antibody/antigen interactions. The SARS-CoV-2 antigen used is a stabilized pre-fusion spike protein ((2P), Δfurin, T4 foldon, His-Tag) produced in ES-293 cells. The ELISA was developed and qualified for human serum at Nexelis, Laval, Canada.

In brief, purified SARS-CoV-2 Pre-Spike Antigen was adsorbed to the wells of a microplate and diluted serum samples (test samples, standard, and quality controls) were added. Unbound sample was washed away, and enzyme-conjugated anti-human IgG added. After washing excess conjugate away, 3,3',5,5'-Tetramethylbenzidine (TMB) colorimetric substrate was added. After the established time period, the reaction was stopped. A reference standard on each tested plate was used to quantify the amount of antibodies against SARS-CoV-2 Pre-Spike in the sample according to the unit assigned by the standard (ELISA Laboratory Unit per milliliter: ELU/mL).

Intracellular Cytokine Staining (ICS)

T-cell responses to the S protein of SARSCoV2 were characterized by a 27-color ICS qualified at the HIV Vaccine Trials Network Laboratories, Fred Hutchinson Cancer Research Center (HVTN, FHCRC), Seattle, Wash., United States.

Cryopreserved peripheral blood mononuclear cells (PBMC) were thawed and rested overnight, then stimulated for 6 hours at 37° C. with two consensus peptide pools covering the entire length of the SARSCoV2 S protein, with dimethyl sulfoxide (DMSO) (negative control) or staphylococcal enterotoxin B (SEB) (positive control). Brefeldin A was included during the stimulation to prevent cytokine release. Cells were stained first with the viability dye, second with the extracellular antibody cocktail, then fixed and permeabilized and stained with the antibody cocktail for intracellular markers, including Th1 and Th2 cytokines. Cell fluoerescence was acquired with 5-laser 30-parameter Becton-Dickinson FACSymphony cytometers and analyzed using the FlowJo software.

Statistical Methods

This study was designed to assess safety and immunogenicity. Safety data were analyzed descriptively in the full analysis set and immunogenicity data were analyzed in the per protocol immunogenicity population. SARS-CoV-2 Spike (S) binding antibody titers expressed as ELISA Unit per milliliters (EU/mL) and neutralizing antibody titers in the wtVNA, expressed as the reciprocal serum dilution neutralizing 50% of the test virus dose (50% inhibitory concentration [IC50]), are displayed on a log 10 scale and described using GMT and 95% confidence intervals (CIs). For both assays, seroconversion was defined as having an antibody titer above the lower limit of quantification (LLOQ) post vaccination if the baseline titer was below the LLOQ, or a 4-fold increase over baseline post vaccination if the baseline titer was above the LLOQ. ICS responses were described as % of parent population. Sample positivity was determined with a one-sided Fisher's exact test comparing non-stimulated vs S peptide stimulated wells. LLOQ was 0.22% and non-quantifiable values were imputed to LLOQ/2. Th1/Th2 ratio was calculated if the Th1 and/or Th2 responses were positive and was above 2×LLOQ. If the Th1 or Th2 response from a participant was not fulfilling these criteria, the Th1/Th2 ratio was considered as above 1 if no Th2 response and below 1 if no Th1 response.

Results

Study Participants

Participants were screened as of Jul. 13, 2020, vaccinations of cohort 1a and 1b participants (age 18-55) were initiated on Jul. 22, 2020 (cohort 1a), on Jul. 22, 2020 (Cohort 1b) and first vaccinations were completed for Cohort 1a on Aug. 4, 2020 and for cohort 1 b on Aug. 7, 2020. 575 volunteers were screened, of whom 380 were enrolled in cohort 1a (377 vaccinated) and 28 were screened and 25 enrolled in cohort 1b (25 vaccinated) (FIGS. 102A and 102B, respectively). 7 (1.7%) participants were seropositive for SARS-CoV-2 at screening, seropositivity rate for Ad26 will be reported later. Vaccinations of cohort 3 participants (age >65) were initiated on Aug. 3, 2020 and first vaccinations were completed on Aug. 24, 2020. 660 volunteers were screened, of whom 405 were enrolled (394 vaccinated) (FIG. 102C). Immunogenicity results of only the first 15 participants of cohort 3 were available. Baseline characteristics were broadly comparable across groups.

Vaccine Safety and Reactogenicity

Solicited AEs were collected on Diary cards for 7 days post vaccination, unsolicited AEs for 28 days after vaccination and SAEs throughout the course of the study. In order for the participants and investigators evaluating the participants in these two studies to remain blinded, safety data is presented without group unblinding in this interim report.

In cohorts 1a and 1b (age 18-≤55 years of age) the investigator's assessment of reactogenicity is available for 402 participants, of whom 288 (72%) participants have reported solicited AEs. Solicited local AEs were reported in 235 (58%) participants—mostly grade 1/grade 2. Three participants reported grade 3 pain/tenderness. The most frequent AE was injection site pain. Solicited systemic AEs were reported for 258 (64%) participants, mostly grade 1/grade 2, with grade 3 systemic AEs reported for 46 (11%) participants. The most frequent AEs were fatigue, headache and myalgia. Fever was reported for 76 (19%) participants, with grade 3 fever reported for 22 (5%) participants. Overall, 98 participants have reported 178 unsolicited AEs with 12 reporting grade 3 AEs.

In cohort 3 (age ≥65) overall, investigator's assessment of reactogenicity is available for 394 participants, of whom 183 (46%) participants have reported solicited AEs. Solicited local AEs were reported in 108 (27%) participants, most of which were grade 1/grade 2, with 1 participant reporting grade 3 swelling and erythema. The most frequent AE was injection site pain. Solicited systemic AEs were reported in 140 (36%) participants, most of which were grade 1/grade 2, with 3 participants reporting grade 3 AEs. The most frequent AEs were headache, fatigue and myalgia. Mild or moderate fevers of grade 1 or 2 was reported in 14 (4%) participants, only 1 of which was grade 2. There were no high or other fevers that restricted daily living activities (Grade 3) reported in cohort 3. Overall, 46 participants have reported 77 unsolicited AEs. 4 participants have reported unsolicited grade 3 AEs. No grade 4 AEs, solicited or unsolicited, were reported in any cohort.

No participant discontinued the study due to an AE. There were two SAEs: one hypotension judged by the investigator to not be vaccine related because of a past history of recurrent hypotension and one participant with fever was hospitalized overnight because of suspicion of COVID-19 and recovered within 12 hours.

Immunogenicity of Ad26.COV2.S

Antibodies against a stabilized SARS-CoV-2 full length Spike protein were measured by ELISA. In cohort 1a, 94% and 98% of the participants at baseline had geometric mean titers (GMTs) to SARS-CoV-2 S protein below the LLOQ which at day 29 after vaccination, had increased to 528 (95% CI: 442; 630) and 695 (95% CI: 596; 810), for the $5\times10^{10}$ and $1\times10^{11}$ vp dose groups, respectively, with 99% seroconversion in each dose group (FIG. 103A). 88% (7/8) and 67% (2/3) of the cohort 1a participants that were seropositive at baseline demonstrated the preset criterion of a 4-fold increase in binding antibody titer to be considered a vaccine responder, for the $5\times10^{10}$ and $1\times10^{11}$ vp dose groups, respectively. All 15 first enrolled participants in cohort 3 were seronegative at baseline and seroconverted by 29 days post vaccination with GMTs of 507 (95% CI: 181; 1418) and 248 (95% CI: 122; 506), for the $5\times10^{10}$ and $1\times10^{11}$ vp doses, respectively. GMTs of 899 were observed in the human convalescent serum (HCS) panel used in this study, with an overlap in the 95% CI of the GMT for both doses in each cohort, indicating no major difference with vaccine elicited titers.

Figure 103A:
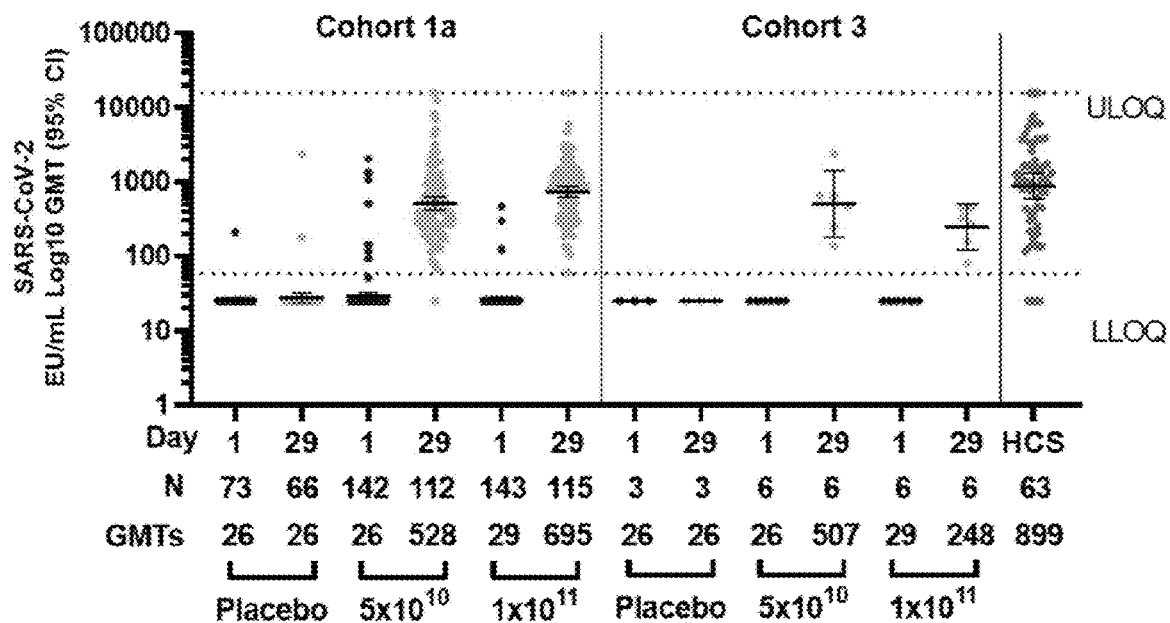
Figure 103B:
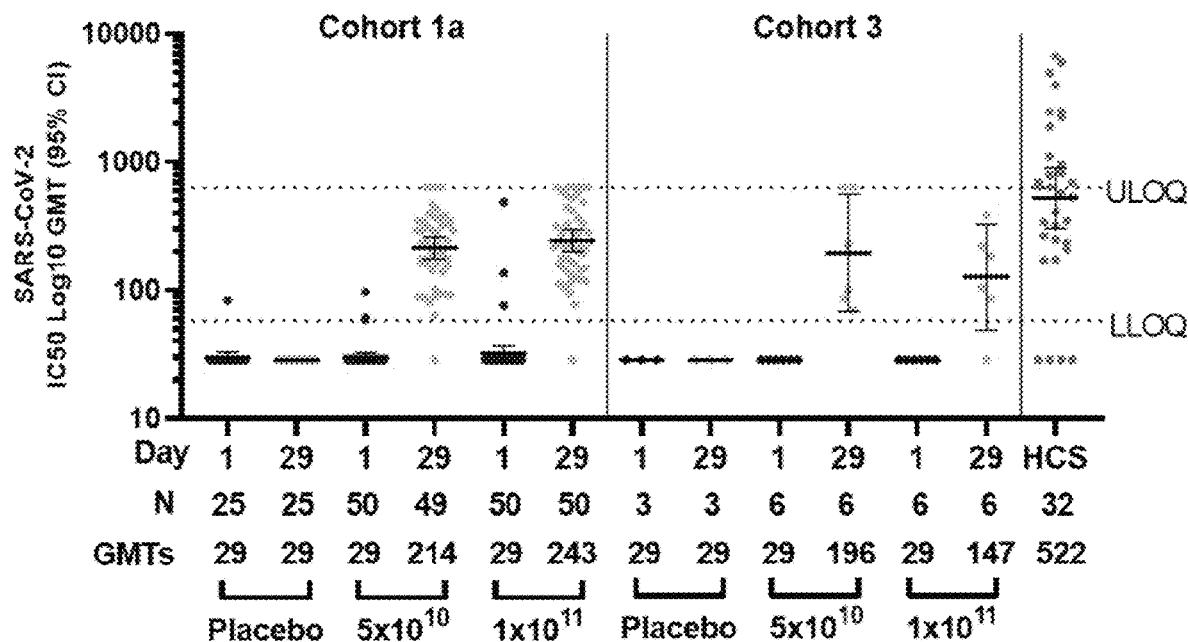
Figure 103C:
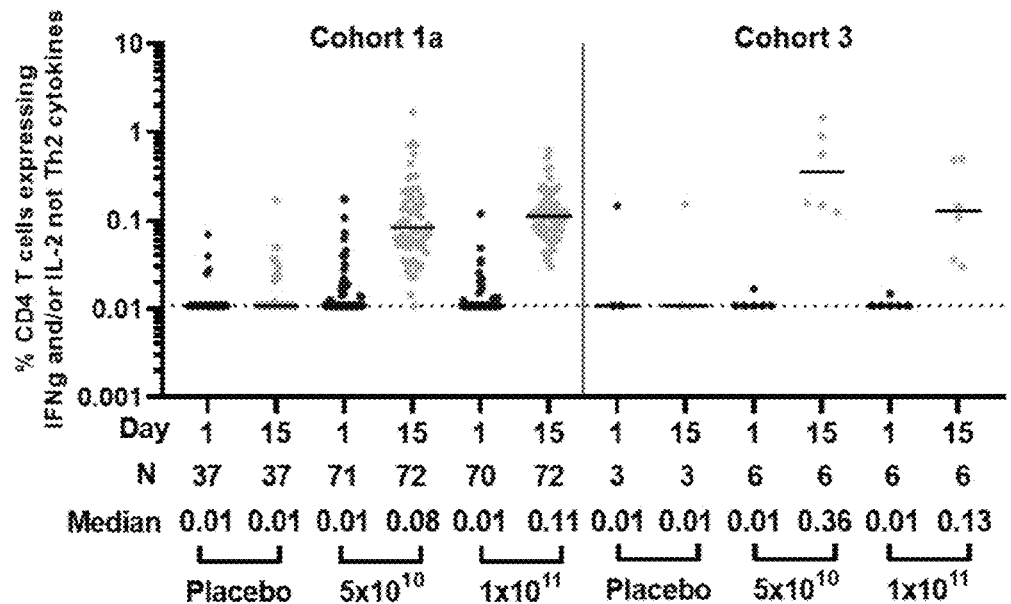

In a subset of participants (n=50 for each of the $5\times10^{10}$ vp and $1\times10^{11}$ vp dose group), SARS-CoV-2 neutralizing antibody levels were measured by wtVNA. In cohort 1a, GMTs <LLOQ at baseline for both dose groups increased to IC50 GMTs of 214 (95% CI: 177; 259) and 243 (95% CI: 200; 295) for the $5\times10^{10}$ and $1\times10^{11}$ vp group, respectively, on day 29. Similar results were observed in the sentinel group of cohort 3, with a GMT <LLOQ at baseline that increased to GMTs of 196 (95% CI: 69; 560) and 127 (95% CI: <LLOQ; 327) for the $5\times10^{10}$ and $1\times10^{11}$ vp group, respectively, at day 29 (FIG. 103B). For comparison, a GMT of 522 was measured in the HCS panel used in this analysis, with an overlap in the 95% CI of the GMT between HCS panel and both dose groups and cohorts. Several vaccine study samples reached the upper limit of quantification (ULOQ=640) for vaccine sample analysis run and are being reanalyzed. Testing of a higher dilution of the sample will allow for the determination of higher titers with a higher ULOQ. HCS samples were tested at higher dilution than vaccine study samples, therefore some of these samples have a titer above the ULOQ presented here. At day 29 post vaccination, 98% of participants in cohort 1a were positive for neutralizing antibodies against SARS-CoV-2, independent of vaccine dose that was given. The seroconversion rate at day 29 was 92% for both the $5\times10^{10}$ and $1\times10^{11}$ vp group in cohort 1a and, 100% (6/6) and 83% (5/6) for the $5\times10^{10}$ and $1\times10^{11}$ vp group in cohort 3. In cohort 1a, a total of 82% and 94% of participants in the $5\times10^{10}$ and $1\times10^{11}$ vp group, respectively, reached titers greater than 100, indicative of a robust response induced in the vast majority of the participants after a single vaccination with Ad26.COV2.S. The wtVNA and S-ELISA cohort 1a titers highly correlated, with a Spearman correlation of 0.86. Data from a pseudovirus expressing SARS-CoV-2 S protein neutralization assay are pending and will be included in the full publication of our post dose 1 interim analysis. SARS-CoV-2 S specific CD4+ and CD8+ T cell responses were characterized in a subset of study participants at baseline and 15 days post vaccination. Following stimulation with peptides covering the whole S protein, CD4+Th1 responses increased from undetectable at baseline to 0.08% (95% CI: 0.05; 0.16) and 0.11 (95% CI: 0.07; 0.16) 15 days post vaccination for the $5\times10^{10}$ and $1\times10^{11}$ vp group, respectively, in cohort 1a participants, and from non-detectable at baseline to 0.36% (95% CI: 0.15; 0.89) and 0.13 (95% CI: 0.04; 0.50) for the $5\times10^{10}$ and $1\times10^{11}$ vp group, respectively, in the sentinel group of cohort 3 (FIG. 103C). 76% (95% CI: 65; 86) and 83% (95% CI: 73; 91) Th1 positive responses were observed for recipients of the $5\times10^{10}$ and $1\times10^{11}$ vp dose, respectively, in cohort 1a. In the first 15 participants of cohort 3, 100% (95% CI: 54; 100) and 67% (95% CI: 22; 96) Th1 positive responses were observed in recipients of the $5\times10^{10}$ and $1\times10^{11}$ vp dose, respectively. No Th2 responses were quantifiable (values imputed to LLOQ/2) in either cohort, with the exception of one participant in the $5\times10^{10}$ vp group in cohort 1a (FIG. 103C). However, the Th1/Th2 ratio for this participant was 28.9, indicative of a Th1-skewed phenotype. In all other participants that had measurable Th1 and/or Th2 responses, the Th1/Th2 ratio ranged from 1.0 to 68.5. Overall, these data indicate that Ad26.COV2.S induced Th1-skewed responses in both age groups.

S specific CD8+ T cell responses were identified by the expression of IFNg and/or IL-2 cytokines upon S peptide stimulation (FIG. 103D). 15 days post vaccination, the magnitude of S specific CD8+ T cell responses was 0.07% (95% CI: 0.03; 0.19) and 0.09% (95% CI: 0.05; 0.19) for the $5\times10^{10}$ and $1\times10^{11}$ vp group, respectively, in cohort 1a, and 0.05% (0.02; 0.24) for and to 0.07% (0.02; 0.14) for the $5\times10^{10}$ and $1\times10^{11}$ vp group, respectively, in cohort 3. 51% (95% CI: 39; 63) and 64% (95% CI: 52; 75) of participants had a positive CD8+ T cell response to S peptide stimulation for the $5\times10^{10}$ and $1\times10^{11}$ vp group, respectively, in cohort 1a, and 33% (95% CI: 4%; 78%) of participants of both dose groups in cohort 3 showed a robust vaccine induced CD8+ T cell response.

Discussion

The interim analysis of our Phase 1/2a study shows that the vaccine candidate Ad26.COV2.S has an acceptable safety and reactogenicity profile and is immunogenic at both a $5\times10^{10}$ vp or $1\times10^{11}$ vp dose.

A single dose of Ad26.COV2.S elicited strong humoral responses in the vast majority of vaccine recipients. S-binding antibody levels as measured by ELISA increased from baseline to day 29 post vaccination in 99% of the participants in cohort 1a and 100% of the first participants in cohort 3, independent of the vaccine dose level that was given. Similarly, high response rates were observed in a wtVNA. 29 days post vaccination 98% of the participants had detectable neutralizing antibodies. 92% of Cohort 1a participants and respectively 6 out of 6, and 5 out of 6 recipients of the $5\times10^{10}$ vp and $1\times10^{11}$ vp dose in cohort 3, seroconverted for SARS-CoV-2 neutralizing antibodies. In cohort 1a, 84% to 92% of the participants had a neutralizing antibody titer above 100. The neutralizing antibody responses in nearly all participants reported here were obtained after a single dose of Ad26.COV2.S.

These clinical data indicate that Ad26.COV2.S at both dose levels induces a strong neutralizing antibody response in the vast majority of the healthy young and older participants in stable health. Although only a limited number of participants of cohort 3 were included in the analysis so far, the similar immunogenicity of Ad26.COV2.S in adults aged 18-55 and adults aged >65 as observed here is encouraging as protection of elderly who are at much higher risk for developing severe COVID-19 is extremely important, notably to achieve a reduction of the pressure on health care systems during this pandemic. Compared to COVID-19 human convalescent sera, the levels of binding and neutralizing antibodies induced by Ad26.COV2.S seemed to be lower, albeit in the same range for most participants. However, the significance of this comparison is not yet established due to the variability of the composition of human serum panels as well as non-standardization of convalescent serum antibody assays. Using a different HCS panel, the comparison (ratio) with vaccine sample titers would be different. Demographics such as age, disease severity, and time since disease onset and the number of samples in the panel could have an impact on the level of antibody measured making a proper comparison to vaccine samples arbitrary.

Previous experience with animal models of SARS-CoV and MERS-CoV vaccines have raised concerns about vaccine-associated enhanced respiratory disease (VAERD). Association between this safety concern and poor neutralizing potency of humoral immunity and Th2-skewing has been suggested. Here it is shown that Ad26.COV2.S elicited T cell responses were overwhelmingly Th1 skewed with no or very low Th2 responses. Indeed, in all responders, the Th1/Th2 ratio was above 1, in line with our previous experience with the Ad26 based vaccine platform. This robust Th1 response was accompanied by strong CD8+ T cell response following vaccination. Overall robust induction of CD4+Th1 and CD8+ T cell responses, in addition to strong humoral responses elicited by Ad26.COV2.S minimizes the theoretical risk of VAERD. Obviously, an efficacious single-dose COVID-19 vaccine would have great advantages over a two-dose vaccine schedule for use in the current pandemic and significantly increase the probability of an immediate impact on the time frame in which the SARS-CoV-2 pandemic could be controlled. Provided the immune responses elicited by a single dose of Ad26.COV2.S can protect against SARS.CoV.2 infection or COVID-19, an important unknown is the durability of this immune response. Data on the durability of the immune response elicited by a single dose of Ad26.COV2.S as well as on the immune response after a second dose of Ad26.COV2.S will become available from this ongoing ph1/2a study.

In conclusion, the safety profile and immunogenicity after a single vaccination are supportive for the further clinical development of Ad26.COV2.S as a potentially protective vaccine against COVID-19. This interim analysis indicates that a single dose of Ad26.COV2.S, either with a dose of $5 \times 10^{10}$ vp or $1 \times 10^{11}$ vp, is safe, well tolerated and highly immunogenic. Based on similar immunogenicity of both dose levels, the $5 \times 10^{10}$ vp dose has been selected for further evaluation. In a first Phase 3 study, the efficacy of a single dose of $5 \times 10^{10}$ vp of the Ad26.COV2.S vaccine candidate will be evaluated. An additional Phase 3 study is in preparation to assess the efficacy and durability of immunity of a two dose schedule with the $5 \times 10^{10}$ vp Ad26.COV2.S vaccine.

Example 24. A Randomized, Double-Blind, Placebo-Controlled, First-In-Human (FIH) Phase 1/2a Multicenter Study in Adults Aged ≥18 to ≤55 Years and Aged ≥65 Years Evaluating the Safety, Reactogenicity, and Immunogenicity of Ad26.COV2.S—Cohort 3 Interim Analysis Immunogenicity Report This Cohort 3 interim analysis includes group unblinded humoral immunogenicity data from wild-type virus neutralization assay (wtVNA) and enzyme-linked immunosorbent assay (ELISA), collected up to (and including) the 28-day post-first dose visit (Day 29). In addition, cellular immunogenicity data from intracellular cytokine staining (ICS) collected up to (and including) the 14-day post-first dose visit (Day 15) for a subset of participants, is described.

Objectives and Endpoints

The objectives/endpoints of this study, applicable to the interim analysis of Cohort 3, are provided below:

| Objectives | Endpoints |
| --- | --- |
| Secondary | |
| To assess the humoral and cellular immune response to Ad26.COV2.S. | Humoral Immune Response<br>All participants in Cohort 3:<br>SARS-CoV-2 neutralization titers in serum measured by psVNA[a] or wtVNA.<br>SARS-CoV-2 binding antibodies measured by ELISA.<br>Cellular Immune Response<br>A subset of participants in Cohort 3:<br>T helper (Th) 1 and Th2 immune responses as assessed by flow cytometry after SARS-CoV-2 S protein peptide stimulation of peripheral blood mononuclear cells (PBMCs) and ICS including CD4+/CD8+, interferon gamma (IFNγ), interleukin (IL)-2, tumor necrosis factor alpha (TNF-α)[b], IL-4, IL-5, IL-13, and/or other Th1/Th2 markers. |

[b]TNF-α is not included in the Cohort 3 interim immunogenicity analysis

Methods

Overview of Study Design

The study design was described in Example 23.

Immunogenicity

For humoral immunogenicity (wtVNA and ELISA), a sample will be considered positive if the value is strictly greater than the LLOQ (>LLOQ). The responder definition for humoral immunogenicity is defined as:

The baseline sample value is less than or equal to the LLOQ (≤LLOQ) and the post-baseline sample is strictly greater than the LLOQ (>LLOQ)

The baseline sample value is strictly greater than the LLOQ (>LLOQ) and the post-baseline sample value represents an at least 4-fold (4-fold) increase from the baseline sample value. For cellular immunogenicity (ICS), positivity of a sample is defined by the Fisher's exact text that compares mock and stimulated conditions.

Assessment of Th1/Th2 Response Ratio

Based on the combined SARS-Cov2-S peptide pool, and using post baseline time points only, a Th1/Th2 response ratio will be calculated for samples that satisfy at least one of the following two conditions:

a Th1 response ("IFN-g or IL2 NOT TH2") that is both positive and ≥2×LLOQ, or a Th2 response ("IL4 or IL5 or IL13 and CD40L") that is both positive and ≥2×LLOQ For the purposes of the Th1/Th2 ratio analysis, the LLOQ is 0.022% for both cell populations (Th1 and Th2).

If both cell populations (Th1 and Th2) are positive and ≥2×LLOQ, then the ratio of Th1/Th2 will be calculated as a numerical result.

If only one cell population (either Th1 or Th2) is positive and 2×LLOQ, then the following rules will be used to determine a qualitative assessment of the Th1/Th2 ratio:

If one cell population is positive and the other is negative, then the positive cell population is greater than the negative cell population: if the Th1 response is positive and the Th2 response is negative, then the Th1/Th2 ratio will be set to ">1". If the Th1 response is negative and the Th2 response is positive, then the Th1/Th2 ratio will be set to "<1"

If both cell populations are positive, then the cell population that is ≥2×LLOQ is greater than the cell population that is <2×LLOQ: if the Th1 response is ≥2×LLOQ and the Th2 response is <2×LLOQ, then the Th1/Th2 ratio will be set to ">1". If the Th1 response is <2×LLOQ and the Th2 response is ≥2×LLOQ, then the Th1/Th2 ratio will be set to "<1".

Results

This Example describes the analysis of humoral immune response data (wtVNA and ELISA), collected in Cohort 3 up to (and including) the 28-day post-dose 1 visit (Day 29). In addition, this Example describes the cellular immune response data (ICS), collected in Cohort 3 up to (and including) the 14-day post dose 1 visit (Day 15) for a subset of participants. A summary of the immunogenicity data is provided below.

Demographic and Baseline Characteristics

Participant demographics and baseline characteristics are summarized in Table 2. Most participants were white (09.5%). Overall, 50.1% of participants were female and 49.9% were male. The median age was 69.00 years (range: 65.0-88.0 years) and the median body mass index (BMI) was 25.700 kg/m$^2$ (range: 16.60-29.90 kg/m$^2$). Demographics and baseline characteristics were generally well balanced between vaccination groups.

TABLE 2

Summary of Demographics and Baseline Characteristics; Cohort 3; Full Analysis Set (Study VAC31518COV1001)

|  | Ad26 5e10 | Ad26 1e11 | Placebo | All Subjects |
|---|---|---|---|---|
| Analysis set: Full | 161 | 161 | 81 | 403 |
| Age (years) | | | | |
| N | 161 | 161 | 81 | 403 |
| Mean (SD) | 69.63 (3.990) | 69.99 (4.249) | 69.89 (3.732) | 69.83 (4.040) |
| Median | 69.00 | 69.00 | 69.00 | 69.00 |
| Range | (65.0; 83.0) | (65.0; 88.0) | (65.0; 79.0) | (65.0; 88.0) |
| 65-75 years | 148 (91.9%) | 148 (91.9%) | 74 (91.4%) | 370 (91.8%) |
| >75 years | 13 (8.1%) | 13 (8.1%) | 7 (8.6%) | 33 (8.2%) |
| Sex | | | | |
| N | 161 | 161 | 81 | 403 |
| Female | 77 (47.8%) | 82 (50.9%) | 43 (53.1%) | 202 (50.1%) |
| Male | 84 (52.2%) | 79 (49.1%) | 38 (46.9%) | 201 (49.9%) |
| Undifferentiated | 0 | 0 | 0 | 0 |
| Race | | | | |
| N | 161 | 161 | 81 | 403 |
| White | 158 (98.1%) | 158 (98.1%) | 81 (100.0%) | 397 (98.5%) |
| Black or African American | 1 (0.6%) | 2 (1.2%) | 0 | 3 (0.7%) |
| Asian | 0 | 0 | 0 | 0 |
| Native Hawaiian or other Pacific Islander | 0 | 0 | 0 | 0 |
| American Indian or Alaska Native | 1 (0.6%) | 0 | 0 | 1 (0.2%) |
| Multiple | 0 | 0 | 0 | 0 |
| Unknown | 1 (0.6%) | 0 | 0 | 1 (0.2%) |
| Not reported | 0 | 1 (0.6%) | 0 | 1 (0.2%) |
| Ethnicity | | | | |
| N | 161 | 161 | 81 | 403 |
| Hispanic or Latino | 1 (0.6%) | 2 (1.2%) | 3 (3.7%) | 6 (1.5%) |
| Not Hispanic or Latino | 160 (99.4%) | 159 (98.8%) | 78 (96.3%) | 397 (98.5%) |
| Unknown | 0 | 0 | 0 | 0 |
| Not Reported | 0 | 0 | 0 | 0 |
| Weight (kg) | | | | |
| N | 161 | 161 | 81 | 403 |
| Mean (SD) | 73.917 (11.8631) | 73.584 (12.8941) | 71.806 (13.5441) | 73.360 (12.6223) |
| Median | 72.900 | 73.900 | 69.900 | 72.900 |
| Range | (46.00; 109.10) | (46.30; 108.90) | (45.10; 98.90) | (45.10; 109.10) |
| Height (cm) | | | | |
| N | 161 | 161 | 81 | 403 |
| Mean (SD) | 170.719 (8.8360) | 169.288 (9.8092) | 168.275 (10.5211) | 169.656 (9.6068) |
| Median | 169.200 | 168.500 | 170.000 | 169.000 |
| Range | (146.70; 193.00) | (151.10; 193.00) | (147.50; 193.20) | (146.70; 193.20) |
| BMI (kg/m$^2$) | | | | |
| N | 161 | 161 | 81 | 403 |
| Mean (SD) | 25.272 (2.8286) | 25.515 (2.6968) | 25.205 (3.1319) | 25.356 (2.8370) |
| Median | 25.700 | 25.700 | 25.600 | 25.700 |
| Range | (16.60; 29.90) | (17.90; 29.90) | (17.20; 29.80) | (16.60; 29.90) |
| Study Center | | | | |
| N | 161 | 161 | 81 | 403 |
| BE10001 | 21 (13.0%) | 21 (13.0%) | 10 (12.3%) | 52 (12.9%) |
| BE10002 | 12 (7.5%) | 10 (6.2%) | 5 (6.2%) | 27 (6.7%) |
| BE10003 | 14 (8.7%) | 14 (8.7%) | 7 (8.6%) | 35 (8.7%) |
| BE10004 | 28 (17.4%) | 27 (16.8%) | 14 (17.3%) | 69 (17.1%) |
| US10001 | 23 (14.3%) | 25 (15.5%) | 12 (14.8%) | 60 (14.9%) |
| US10003 | 21 (13.0%) | 21 (13.0%) | 11 (13.6%) | 53 (13.2%) |
| US10004 | 13 (8.1%) | 14 (8.7%) | 8 (9.9%) | 35 (8.7%) |
| US10006 | 15 (9.3%) | 14 (8.7%) | 7 (8.6%) | 36 (8.9%) |
| US10008 | 14 (8.7%) | 15 (9.3%) | 7 (8.6%) | 36 (8.9%) |

TABLE 2-continued

Summary of Demographics and Baseline Characteristics; Cohort 3; Full Analysis Set (Study VAC31518COV1001)

|  | Ad26 5e10 | Ad26 1e11 | Placebo | All Subjects |
|---|---|---|---|---|
| SARS-CoV-2 Seropositivity status at baseline |  |  |  |  |
| N | 161 | 161 | 81 | 403 |
| Positive | 1 (0.6%) | 2 (1.2%) | 1 (1.2%) | 4 (1.0%) |
| Negative | 160 (99.4%) | 159 (98.8%) | 80 (98.8%) | 399 (99.0%) |

Note:
Ns for each parameter reflect non-missing values.
SD: Standard Deviation, Range: minimum value-maximum value
Note:
Ad26 5e10: Ad26.COV2.S 5 × $10^{10}$ vp; Ad26 1e11: Ad26.COV2.S 1 × $10^{11}$ vp.
All subject data up to Sep. 21, 2020 are included.

Immunogenicity Results
Data Sets Analyzed

Analysis of the immunogenicity results was based on the per protocol immunogenicity population consisting of all randomized and vaccinated participants for whom immunogenicity data were available. Post-vaccination 1 immunogenicity results were pooled for groups 1 and 2 (5×$10^{10}$ vp) and for groups 3 and 4 (1×$10^{11}$ vp).

In the full analysis set 1 participant in the 5×$10^{10}$ vp vaccine group, 2 participants in the 1×$10^{11}$ vp vaccine group, and 1 participant in the placebo group were seropositive for SARS-COV-2 at baseline (Table 2).

Humoral Immune Responses

Neutralizing antibodies in Cohort 3 COV1001 participants were measured in a wild-type virus neutralization assay. A random subset of 125 study participants (25 per group) was selected according to a pre-defined subset selection strategy (prospective random sampling stratified by vaccine assignment) by an unblinded independent external statistician.

Neutralizing Antibody Responses Against SARS-CoV-2 Wild-Type Virus Neutralization Assay For this assay, a random subset of 125 study participants (25 per group) was selected according to a pre-defined subset selection strategy (prospective random sampling stratified by vaccine assignment) by an unblinded independent external statistician.

Neutralizing antibody titers against SARS-CoV-2, as measured by wtVNA, are expressed as 50% inhibitory concentration (IC50) units. Graphical representation of VNA responses against SARS-CoV-2 (geometric mean titers [GMTs] with corresponding 95% CIs) over time are presented in FIG. 106.

At baseline, 47 participants in the 5×$10^{10}$ vp vaccine group, 45 participants in the 1×$10^{11}$ vp vaccine group, and 24 participants in the placebo group did not have detectable SARS-CoV-2 IC50 titers (Lower limit of quantification [LLOQ] for the assay was an IC50 of 58). Detectable baseline levels of SARS-CoV-2 IC50 titers, potentially indicative of previous SARS-CoV-2 exposure, were observed in 2 participants in the 5×$10^{10}$ vp vaccine group, 5 participants in the 1×$10^{11}$ vp vaccine group, and no participants in the placebo group (FIG. 106).

At Day 15, 75% of participants in both the active vaccine groups reached IC50 titers greater than 100, indicating that a rapid, robust response was induced in the majority of participants.

The responder rate at Day 15 was 87% for the 5×$10^{10}$ vp vaccine group and 83% the 1×$10^{11}$ vp vaccine group. At Day 15, GMTs were 197 (95% CI:137; 284) and 180 (95% CI:117; 276) for the 5×$10^{10}$ vp and 1×$10^{11}$ vp vaccine groups, respectively. The standard deviation (SD) at Day 15 was similar for the two vaccine groups.

Neutralizing antibody responses at Day 29 were comparable to Day 15 responses. At Day 29 a total of 81% of participants in the 5×$10^{10}$ vp vaccine group and 88% of participants in the 1×$10^{11}$ vp vaccine group reached IC50 titers greater than 100. The responder rate at Day 29 was 90% for the 5×$10^{10}$ vp vaccine group and 91% the 1×$10^{11}$ vp vaccine group. At Day 29, GMTs were 221 (95% CI: 160; 307) and 210 (95% CI: 155; 285) for the 5×$10^{10}$ vp and 1×$10^{11}$ vp vaccine groups, respectively. The standard deviation (SD) was similar for the two vaccine groups.

The magnitude of the neutralizing antibody response, and responder rates, may be underestimated by the current analysis, since post vaccination titers in some participants reached the upper limit of quantification (ULOQ) of the assay. These samples will be re-analyzed at a later stage, with higher dilutions, to allow for the determination of individual titers. Increased wtVNA titers were not observed in the placebo group at Day 15 or Day 29.

Responder status was missing for three of the participants showing detectable levels of SARS-CoV-2 neutralizing antibodies at baseline. The remaining four participants, all in the active vaccine regimens, showed increased GMT at Day 15 and Day 29. However, not all of these participants met the predefined responder criteria.

A trend for a decline in neutralizing antibody response with increasing age was not observed. When comparing the Cohort 3 and Cohort 1a neutralizing antibody data for both vaccine groups at Day 29, the magnitude of the antibody responses (GMT, Cohort 3 vs Cohort 1a: 221 vs 214 for the 5×$10^{10}$ vp vaccine group and 210 vs 243 for the 1×$10^{11}$ vp vaccine group) and responder rates in Cohort 3 are within the same range as Cohort 1a.

The antibody levels at Day 29 of participants in the 5×$10^{10}$ vp group who used (185 GMT, 78% responders) and those who did not use (238 GMT, 95% responders) antipyretics/analgesics post vaccination were similar. At Day 29, the antibody levels of participants in the 1×$10^{11}$ vp group who used (229 GMT, 90% responders) and those who did not use (202 GMT, 91% responders) antipyretics/analgesics post vaccination were also similar, indicating that the use of these medications does not appear to impact the neutralizing antibody response, as measured by wtVNA.

The reverse cumulative distribution curves for the $5 \times 10^{10}$ vp vaccine group and the $1 \times 10^{11}$ vp vaccine group were similar at both Day 15 and Day 29 (FIG. 107).

Binding Antibody Responses Against SARS-CoV-2 S Protein (ELISA)

Descriptive statistics of SARS-CoV-2 S protein binding antibody responses induced by Ad26.COV2.S, as measured by ELISA, actual values and fold increase from baseline (with corresponding 95% CI) are graphically represented in FIG. 108.

Detectable baseline levels of SARS-CoV-2 S ELISA titers, potentially indicative of previous SARS-CoV-2 exposure, were observed in 2 participants in the $5 \times 10^{10}$ vp vaccine group, 3 participants in the $1 \times 10^{11}$ vp vaccine group, and 3 participants in the placebo group. One of these participants, who was in the $1 \times 10^{11}$ vp vaccine group, showed SARS-COV-2 seropositive status at screening.

The responder rate at Day 15 was 75% and 77% for the $5 \times 10^{10}$ vp and $1 \times 10^{11}$ vp vaccine groups, respectively. The corresponding GMTs were 122 (95% CI: 97; 152) and 141 (95% CI: 114; 175) for the $5 \times 10^{10}$ vp and $1 \times 10^{11}$ vp groups, respectively (FIG. 108). An increase in protein binding antibodies was not observed in the placebo group.

Binding antibody responses at Day 29 were higher than those seen at Day 15. The responder rate at Day 29 was 96% for both active vaccine groups. At Day 29, the GMTs were 312 (95% CI: 246; 396) and 350 (95% CI: 284; 431) for the $5 \times 10^{10}$ vp and $1 \times 10^{11}$ vp groups, respectively. The SD was similar for the two vaccine groups. No increases in protein binding antibodies post vaccination, both in GMT and responder rates, were observed in the placebo group at both time points.

A trend of declining binding antibody responses with increasing age within Cohort 3 was not observed. When comparing the Cohort 3 and Cohort 1a binding antibody data for both vaccine groups at Day 29, the magnitude of the antibody responses (GMT, Cohort 3 vs Cohort 1a: 312 vs 528 for the $5 \times 10^{10}$ vp vaccine group and 350 vs 695 for the $1 \times 10^{11}$ vp vaccine group) in Cohort 3 are lower, but within the same range as Cohort 1a (FIG. 110). Binding antibody responder rates were comparable between Cohort 1a and Cohort 3, at 99% and 96%, respectively (FIG. 108 and FIG. 110).

The levels of binding antibodies at Day 15 and Day 29 in participants who used antipyretics/analgesics post vaccination were similar to those who did not. The GMT and responder rate of the $5 \times 10^{10}$ vp group at Day 29 who used antipyretics/analgesics was 357 and 94%, respectively. The GMT and responder rate of the $5 \times 10^{10}$ vp group at Day 29 who did not use antipyretics/analgesics was 302 and 97%, respectively.

The GMT and responder rate of the $1 \times 10^{11}$ vp group at Day 29 who used antipyretics/analgesics was 357 and 94%, respectively. The GMT and responder rate of the $5 \times 10^{10}$ vp group at Day 29 who did not use antipyretics/analgesics was 302 and 97%, respectively.

The reverse cumulative distribution curves for the $5 \times 10^{10}$ vp vaccine group and the $1 \times 10^{11}$ vp vaccine group were similar (FIG. 111).

wtVNA Versus ELISA

Further examination of humoral assay correlations indicated that wtVNA titers highly correlated with ELISA titers at both Day 15 and Day 29, with Spearman Correlation coefficients of 0.734 and 0.72; respectively (FIG. 112). The correlation is robust within the low and high range of both assays, indicating that the ELISA could be used as a surrogate for the wtVNA in future analyses.

Cellular Immune Responses Against SARS-CoV-2 S Peptides

The Th1 and Th2 responses were evaluated by ICS on Day 1 (pre-vaccination) and Day 15 post-dose 1. PBMCs were collected in a subset of participants CD4+/CD8+ T Cell Responses (ICS)

The induction of CD4+ and CD8+ T-cell responses was determined by ICS after stimulation of PBMC with SARS-CoV-2 S peptides (peptide pools S1 and S2). Measurement of T-helper (Th)1 responses were characterized by the percentage of CD4+ T cells producing IFNγ and/or IL-2 and not IL-4, IL-5 and/or IL-13. A Th2 response was determined as the percentage of CD4+ T cells expressing IL-4 and/or IL-5/IL-13 and CD40L. This data was used to determine the Th1/Th2 ratio. Detection of CD8+ T cell responses was characterized by the percentage of CD8+ T cells producing IFNγ and or IL-2. In the summary of CD4+ and CD8+ T cell responses below, the combined values for S1 and S2 peptide pools are presented and discussed.

CD4+ T-Cell Responses

The percentage of CD4+ T cells expressing IFNγ and/or IL-2 (Th1), and not Th2 cytokines, and expressing IL-4 and/or IL-5/IL-13 and CD40L (Th2) are presented in FIG. 113. Combined regimen profile is provided in FIG. 114.

Th1 Responses

Figure 45:
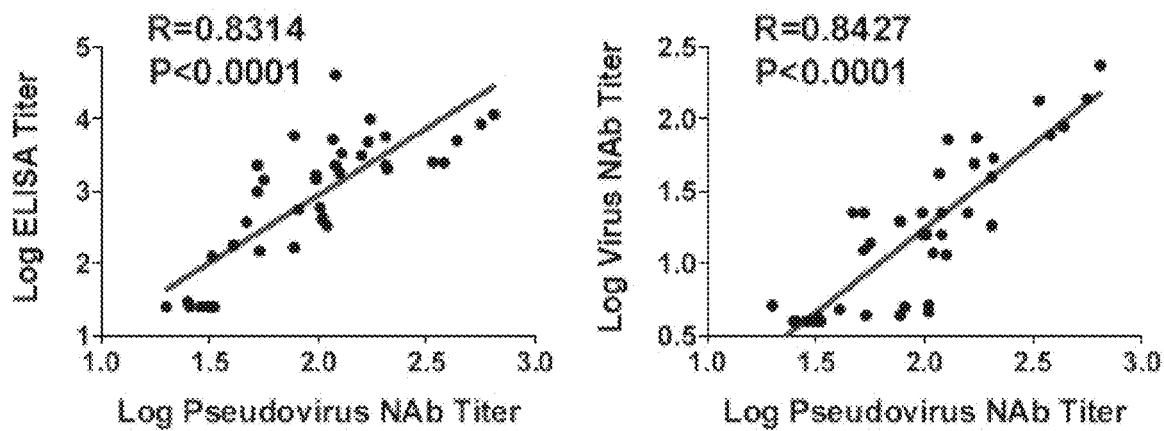
FIG. 45 is a pair of graphs showing correlation of pseudovirus NAb titers and ELISA or live virus NAb assays in vaccinated macaques. Red line reflects the best linear fit relationship between these variables. P and R values reflect two-sided Spearman rank-correlation tests.
Figure 46:
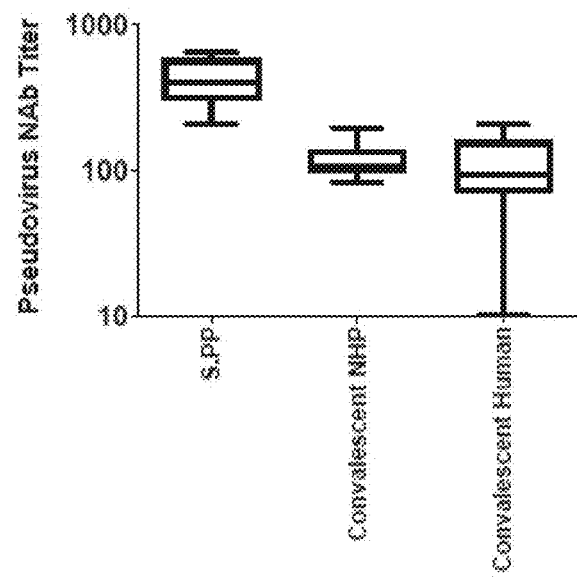
FIG. 46 is a graph showing a comparison of pseudovirus NAb titers in vaccinated macaques and convalescent macaques and humans. Comparison of pseudovirus NAb in macaques vaccinated with Ad26-S.PP (Ad26 SS-Spike-dF-PP) with previously reported cohorts of convalescent macaques and convalescent humans who had recovered from SARS-CoV-2 infection.
Figure 47:
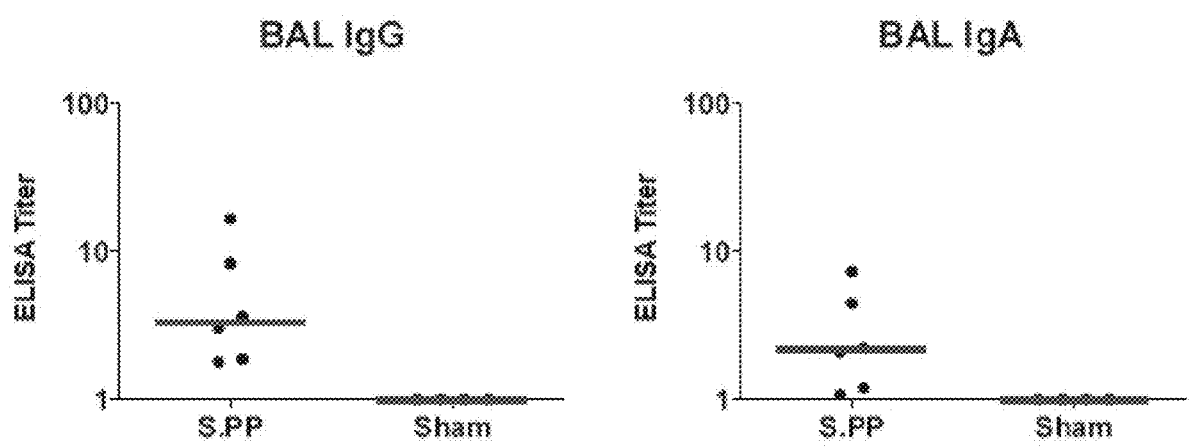
FIG. 47 is a pair of graphs showing humoral immune responses in BAL in vaccinated rhesus macaques. S-specific IgG and IgA at week 4 in BAL by ELISA in sham controls and in Ad26-S.PP (Ad26 SS-Spike-dF-PP) vaccinated animals. Red bars reflect median responses. Dotted lines reflect assay limit of quantitation.
Figure 48:
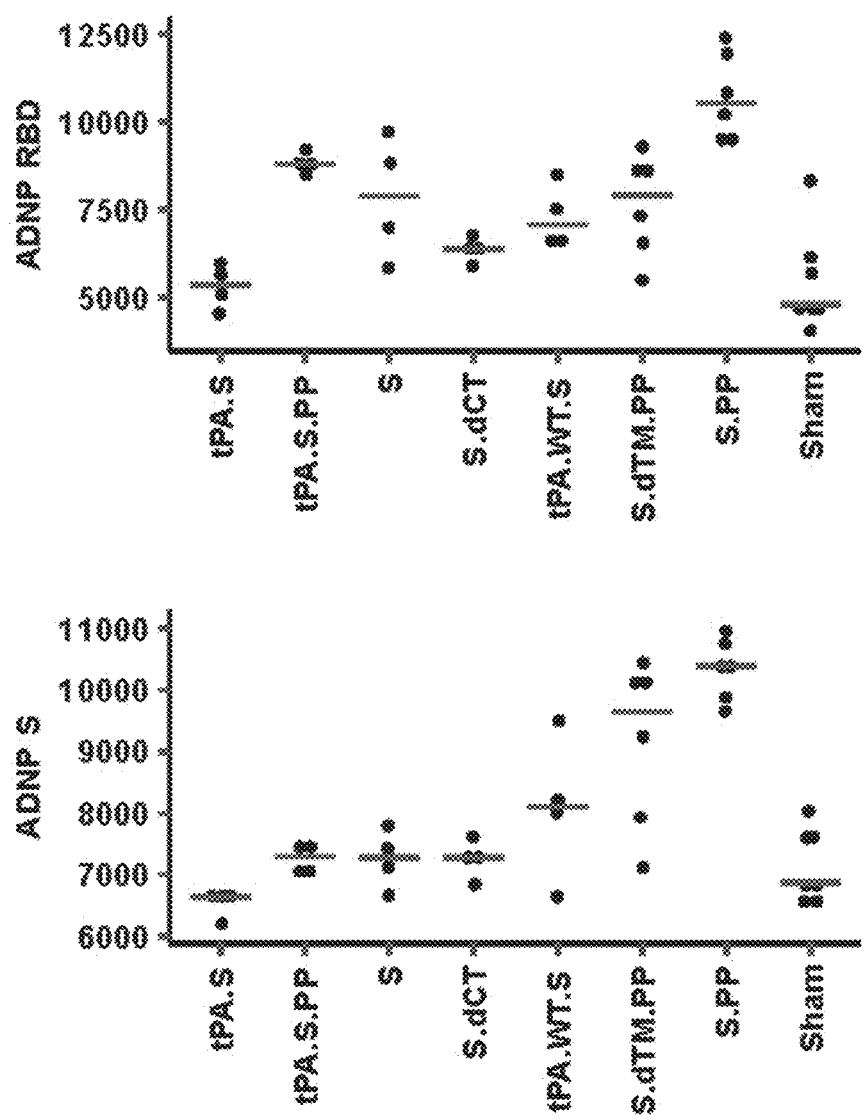
FIG. 48 is a series of graphs showing humoral immune responses in vaccinated rhesus macaques. S- and RBD-specific antibody-dependent neutrophil phagocytosis (ADNP), antibody-dependent monocyte cellular phagocytosis (ADCP), antibody-dependent complement deposition (ADCD), and antibody-dependent NK cell activation (ADNKA) are shown. Red bars reflect median responses.
Figure 49:
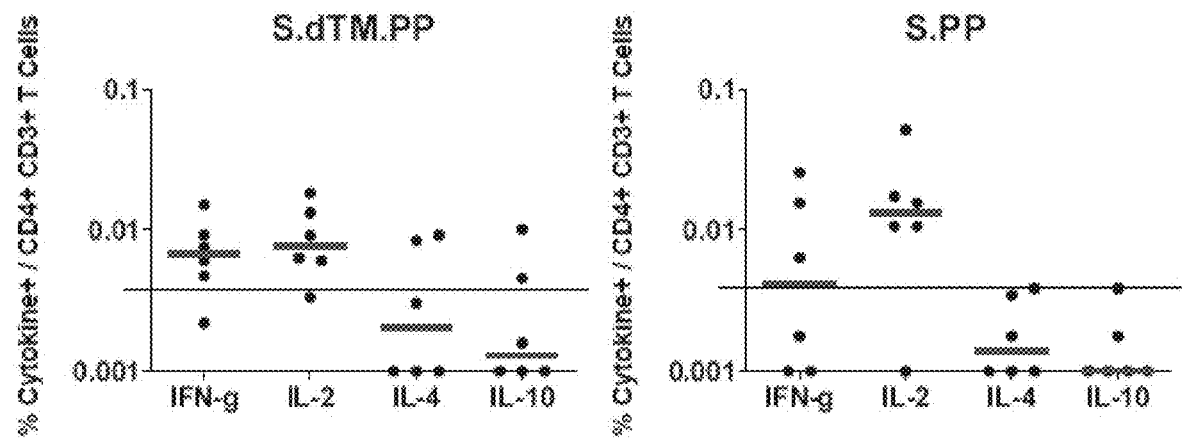
FIG. 49 is a pair of graphs showing cellular immune responses in vaccinated rhesus macaques. IFN-γ+, IL-2+, IL-4+, and IL-10+CD4+ T cell intracellular cytokine staining assays in response to pooled S peptides in Ad26-S.dTM.PP (Ad26 SS-S.Ecto-dF-PP-foldon) and Ad26-S.PP (Ad26 SS-Spike-dF-PP) vaccinated animals. Red bars reflect median responses. Dotted lines reflect assay limit of quantitation.

Baseline Th1 responses were below the LLOQ (<0.022%) at Day 1, for both active vaccine groups and placebo. Median Th1 responses increased 14 days after vaccination to 0.09% (Q1; Q3: 0.04; 0.17) for participants in the $5 \times 10^{10}$ vp vaccination group and to 0.11% (Q1; Q3: 0.04; 0.15) for participants in the $1 \times 10^{11}$ vp dose group (FIG. 45). There was no increase in the Th1 response in the Placebo group 14 days after first vaccination. These responses are comparable to the younger adults from Cohort 1a, which showed median Th1 responses of 0.08% (Q1; Q3: 0.05; 0.16) in the $5 \times 10^{10}$ vp vaccination group and 0.11% (Q1; Q3: 0.07; 0.16) in the $1 \times 10^{11}$ vp dose group on Day 15.

The SD in the $5 \times 10^{10}$ vp vaccine group and the $1 \times 10^{11}$ vp vaccine group were 0.41 and 0.36, respectively.

A total of 60% (95% CI: 46%; 74%) of the participants in the $5 \times 10^{10}$ vp vaccine group and 67% (95% CI: 53%; 79%) of the participants in the $1 \times 10^{11}$ vp vaccine group showed a CD4+ T cell response 14 days post vaccination. This is slightly lower than that seen in Cohort 1a, in which 76% (95% CI: 65%; 86%) of the participants in the $5 \times 10^{10}$ vp vaccine group and 83% (95% CI: 73%; 91%) of the participants in the $1 \times 10^{11}$ vp vaccine group showed detectable CD4+ T cell responses.

Th2 Responses

Th2 responses were undetectable at baseline and Day 15 in both active vaccine groups and placebo (FIG. 113). These results are comparable to the younger adults from Cohort 1a. Only one participant had a Th2 response. This participant, who was included in the $1 \times 10^{11}$ vp vaccine group, also had a Th1 response, which was higher than the Th2 response, with a Th1/Th2 ratio of 20.12, indicative of a Th1 skewed phenotype Th1/Th2 Ratio Calculation Following vaccination with Ad26.COV2.S, the Th1/Th2 ratio was calculated to evaluate T-cell phenotype skewing in participants with a positive T cell response. The Th1/Th2 ratio was above 1 for all participants in the Ad26.COV2.S vaccination groups indicating that overall, Ad26.COV2.S induces a Th1-skewed response. This is comparable to the results in Cohort 1a, which also showed 100% of participants Th1/Th2 ratio above 1 vaccination with Ad26.COV2.S.

CD8+ T-Cell Responses

Descriptive statistics for CD8+ T cells producing IFNγ and/or IL-2 in response to SARS-CoV-2 S peptide stimulation are shown in FIG. 115. Combined regimen profile is provided in FIG. 116. Baseline CD8+ T cell responses before vaccination were below the LLOQ (<0.022%) in both vaccine groups and the placebo group. At 14 days post vaccination, the median level of the CD8+ T cell response increased to 0.06% (Q1; Q3: 0.02; 0.12) for the $5\times10^{10}$ vp group and to 0.02% (Q1; Q3: 0.01; 0.08) for the $1\times10^{11}$ vp group. The CD8+ T cell response did not increase in the placebo group following vaccination. These CD8+ T cell responses in the $5\times10^{10}$ vp group are comparable to that seen in the younger adults in Cohort 1a (0.7%, Q1; Q3: 0.02; 0.12). There is a trend for lower CD8+ T cell responses in the $1\times10^{11}$ vp group than that seen in the younger adults (0.09%, Q1; Q3: 0.05; 0.19).

The SD for the two vaccine groups were 0.40 for the $5\times10^{10}$ vp group and 0.41 for the $1\times10^{11}$ vp group.

A total of 36% (95% CI: 23%; 51%) of the participants in the $5\times10^{10}$ vp group and 24% (95% CI: 13%; 37%) of the participants in the $1\times10^{11}$ vp group showed a CD8+ T cell response 14 days post vaccination. This is lower than the percentage of younger adults in Cohort 1a showing a CD8+ response at Day 15 ($5\times10^{10}$ vp group=51% and $1\times10^{11}$ vp group=64%).

Conclusions and Discussion

Immunological analysis of 15 sentinel participants from Cohort 3 was previously reported. The full Cohort 3 interim analysis is in line with the sentinel report, showing that Ad26.COV2.S is highly immunogenic in participants aged 65 years and older following a single vaccination at dose levels of $5\times10^{10}$ vp or $1\times10^{11}$ vp.

An increase from baseline was observed for SARS-CoV-2 neutralizing and S-binding antibody responses 14 and 28 days post vaccination for both Ad26.COV2.S vaccine groups. The responder rate for the $5\times10^{10}$ vp vaccine group was 90% and 96% for the wtVNA and ELISA, respectively. The responder rate for the $1\times10^{11}$ vp vaccine group was 91% and 96% for the wtVNA and ELISA, respectively.

Ad26.COV2.S also induced cellular immune responses, as assessed by ICS. Increased CD4+ and CD8+ T cell responses were seen 14 Days following a single vaccination with $5\times10^{10}$ vp or $1\times10^{11}$ vp. Following vaccination, CD4+ T cells had a Th1-skewed phenotype and no, or very limited, Th2 responses were observed. In all participants with a T cell response, the Th1/Th2 ratio was >1.

The overall magnitude and responder rates of the humoral responses in Cohort 3 are comparable to the responses observed in Cohort 1a, as previously reported. Cellular CD4+ T cell responses, were similar to the younger adults in Cohort 1a and CD8+ T cell responses were generally lower than that seen in the younger adults in Cohort 1a.

Overall in participants aged 65 years, a single vaccination with $5\times10^{10}$ vp or $1\times10^{11}$ vp Ad26.CoV.2 induces robust neutralizing and binding antibody responses, a Th1-skewed phenotype, and elevated CD4+ and CD8+ T cell responses.

Example 25: A Randomized, Double-Blind, Placebo-Controlled Phase 3 Study to Assess the Efficacy and Safety of Ad26.COV2.S for the Prevention of SARS-CoV-2-Mediated COVID-19 in Adults Aged 18 Years and Older The study will enroll up to 30,000 participants in order to evaluate the efficacy of Ad26.COV2.S in the prevention of molecularly confirmed moderate to severe/critical coronavirus disease-2019 (COVID-19), as compared to placebo, in adult participants.

Detailed Description The aim of the COVID-19 vaccine clinical development program is to develop a safe and effective vaccine for the prevention of COVID-19. Currently, there are no available vaccines for the prevention of COVID-19. Ad26.COV2.S, a COVID-19 vaccine based on a human replication-incompetent Ad26 vector encoding the SARS-CoV-2 S protein is being developed, constructed to encode the severe acute respiratory syndrome coronavirus-2 (SARS-CoV-2) virus spike (S) protein. The study will consist of: a screening phase (up to 28 days), double-blind study period (60-week), and a long-term follow-up period (1 additional year). The total study duration will be maximum 2 years and 3 months for the participants. Assessments like efficacy (COVID-19 like sings and symptoms, etc), immunogenicity (such as humoral immune responses), and safety (such as AEs monitoring) will be performed throughout the study.

Participants will receive intramuscular (IM) injection of Ad26.COV2.S vaccine or placebo on Day 1 and Day 57.

Example 26: Immunogenicity of One- and Two-Dose Regimens of the Ad26.COV2.S COVID-19 Vaccine Candidate in Adult and Aged Rhesus Macaques As shown above in Examples 20 and 21, in nonclinical efficacy studies, a single dose of Ad26.COV2.S provided robust protection against SARS-CoV-2 challenge in both upper and lower airways in rhesus macaques and protected Syrian golden hamsters from severe clinical disease. Protective efficacy strongly correlated with the presence of virus neutralizing activity in serum of NHP. These data corroborate previously reported findings on SARS-CoV, which showed that neutralizing antibody responses against the SARS-CoV Spike (S) protein that binds to the same cellular receptor as SARS-CoV-2 for cell entry, were associated with protection against SARS-CoV in nonclinical models.

The Ad26.COV2.S vaccine candidate according to the invention has been shown to have an acceptable safety and reactogenicity profile and to elicit a prompt and strong immune response after a single dose in both adults and elderly in an interim analysis, as measured up to day 29 post-immunization in a Phase 1/2a study. The immune responses met prespecified minimum criteria to proceed with the testing of Ad26.COV2.S in Phase 3 studies.

In this Example immunogenicity data after one-dose and two-dose regimens of Ad26.COV2.S in both adult and aged NHP for a follow-up period of up to 14 weeks after the first vaccination are reported.

Methods

Animals

Adult NHP—The NHP study including adult animals was conducted at Charles River Laboratories (CRL) Montreal ULC, Laval Site (CA). Animals were obtained from Kunmings Biomed international Ltd, China. Prior to transfer from test facility colony, all animals were subjected to a health assessment and tested at least once for tuberculosis by intradermal injection of tuberculin. An anthelmintic treatment was administered to each animal by subcutaneous injection. The evaluations were performed in accordance with the standard operating procedures by technical staff. Animal experiment approval was provided by the Institutional Animal Care and Use Committee (IACUC) at CRL Montreal ULC, Laval Site (CA). Animal experiments were performed in compliance with Guidelines published by the Canadian Council on Animal Care and the Guide for the Care and Use of Laboratory Animals published by the National Research Council Canada. The Test Facility is accredited by the Canadian Council on Animal Care (CCAC) and the American Association for Accreditation of Laboratory Animal Care (AAALAC). In addition, the study was conducted according to EMA guideline, ICH M3(R2): Guidance on Non-Clinical Safety Studies for the Conduct of Human Clinical Trials and Marketing Authorization for Pharmaceuticals and FDA guideline, Redbook 2000: General Guidelines for Designing and Conducting Toxicity Studies.

Aged NHP—The study using aged NHP was performed at the Biomedical Primate Research Center, Rijswijk, The Netherlands (an AAALAC-accredited institution). Animals were captive-bred for research purposes and socially housed. Animal housing was according to international guidelines for non-human primate care and use (The European Council Directive 86/609/EEC, and Convention ETS 123, including the revised Appendix A as well the 'Standard for humane care and use of Laboratory Animals by Foreign institutions' identification number A5539-01, provided by the Department of Health and Human Services of the United States of America's National Institutes of Health (NIH)). All animal handlings were performed within the Department of Animal Science (ASD) according to Dutch law. A large, experienced staff is available, including full-time veterinarians and a pathologist. ASD is regularly inspected by the responsible authority (Voedsel en Waren Autoriteit, VWA), and by an independent Animal Welfare Officer. Some animals were seropositive for antibodies to Simian Herpes B Virus, while some animals of the mock-immunized control group were positive for antibodies to Simian T-cell Leukemia Virus and Simian Retro Virus. All animals were classified healthy according to physical examination and evaluation of complete blood count and serum chemistry. The Institutional Animal Care and Use Committee of the Biomedical Primate Research Centre (dierexperimentencommissie, DEC-BPRC), approved the study protocols developed according to strict international ethical and scientific standards and guidelines. The qualification of the members of this committee, including their independence from a research institute, is requested in the Dutch law on animal experiments.

Vaccines

The Ad26.COV2.S vaccine has been generated as described herein. Manufacturing of the Ad26 vector was performed in the complementing cell line PER.C6 TetR (Wunderlich et al., 2018) (Zahn et al., 2012). The negative control vector Ad26.RSV.gLuc encodes the RSV F protein fused to Gaussia firefly luciferase as a single transgene separated by a 2A peptide sequence, resulting in expression of both individual proteins. Manufacturing of the vector was performed in PER.C6.

Study Design Animal Experiments

Adult NHP—60 (57 females and 3 males. 3 males were allocated to test groups 3, 4 and 5, 1 male in each group) rhesus macaques (*Macaca mulatta*) from Chinese origin between 3.3 to 5.0 years old were assigned to five groups by a randomizing stratification system based on body weights, fourteen animals were included in each vaccine group and four animals were included in the sham control group. Group 1 (n=4) is the sham control group and received saline injection at week 0 and week 8, group 2 and 3 (n=14 each group) received one immunization with $1\times10^{11}$ viral particles (vp) and $5\times10^{10}$ vp of Ad26.COV2.S, respectively, at week 0, group 4 and 5 (n=14 each group) received two immunization with $5\times10^{10}$ vp of Ad26. COV.2 spaced by four (week 0 and week 4) and eight weeks (week 0 and week 8), respectively. All immunizations were performed via the intramuscular route in the quadriceps muscle of the left hind leg. Blood for serum was obtained prior to the first vaccine dose and every 2 weeks subsequently up to week 14 of the study.

Aged NHP—20 female rhesus macaques (*Macaca mulatta*), aged between 13.75 and 21.9 years, were distributed over 4 experimental treatment groups and housed in ABSL-III facilities, pair-housed with socially compatible animals. Group 1 (n=6) received $1\times10^{11}$ viral particle (vp) of Ad26. COV2.S at week 0. Group 2 (n=6) received $5\times10^{10}$ vp of Ad26. COV2.S at week 0 and 8. Group 3 (n=4) received 100 pg S protein, adjuvanted with 500 pg Aluminum Hydroxide (Al(OH)3; 2% Alhydrogel, InvivoGen) at week 0 an 8. The sham control group (Group 4, n=4) was immunized with $1\times10^{11}$ vp Ad26.RSV.gLuc, an Ad26 vector expressing an irrelevant antigen. All immunizations were performed intramuscularly in quadriceps of the left hind leg. Blood for serum and peripheral blood mononuclear cells (PBMC) isolation was obtained as indicated in the text.

Enzyme-Linked Immunosorbent Assay (ELISA)

IgG binding to SARS-CoV-2 S protein was measured by ELISA using a recombinant S protein antigen based on the Wuhan-Hu-1 SARS-CoV-2 strain (MN908947). The SARS-CoV-2 S protein antigen was adsorbed on 96 well microplates for a minimum of 16 hours at 4° C. Following incubation, plates were washed in PBS/0.05% Tween-20 and blocked with 5% skim milk in PBS/0.05% Tween-20 for 1 hour at room temperature. Serum standards, controls and NHP serum samples were diluted and incubated on the plates for 1 hour at room temperature. The plates were washed and then incubated with peroxidase conjugated goat anti human IgG for 1 hour at room temperature, washed, and developed with tetramethylbenzidine (TMB) substrate for 30 minutes at room temperature and protected from light, then stopped with H2SO4. The optical density was read at 450/620 nm. The antibody concentrations were back calculated on the standard and the reportable value were generated based on all dilutions, expressed in ELISA units [EU]/mL. The lower limit of detection (LLOD) is 3.4 EU/mL, based on the standard lowest interpolation range concentration multiplied per the dilution factor and is used as an informative LLOD. The lower limit of quantification (LLOQ) is based on qualification performed for human samples ad has been set on 50.3 EU/mL.

Pseudovirus Neutralization Assay (psVNA)

SARS-CoV-2 S neutralizing antibody titers were measured by pseudovirus neutralizing assay. Pseudotyped virus particles were made from a modified Vesicular Stomatitis Virus (VSVΔG) backbone and bear the S glycoprotein of the SARS-CoV-2. The pseudoparticles contain a Luciferase reporter used for detection. Serial dilutions of heat-inactivated NHP serum samples were prepared in 96-well transfer plates. The SARS-CoV-2 pseudovirus was added sequentially to the serum dilutions and incubated at 37° C. with 5% CO2 supplementation for 60±5 minutes. Serum-virus complexes were then transferred onto plates, previously seeded overnight with Vero E6 cells, and incubated at 37° C. and 5% CO2 for 20±2 hours. Following this incubation, the luciferase substrate was added to the cells in order to assess the level of luminescence per well. The plates were then read on a luminescence plate reader. The intensity of the luminescence was quantified in relative luminescence units (RLU). The neutralizing titer of a serum sample was calculated as the reciprocal serum dilution corresponding to the 50% neutralization antibody titer (IC50) for that sample. The LLOD is 10, which is the first sample dilution (1:10) used as an informative LLOD. LLOQ is based on qualification performed for human samples has been set on 33 IC50.

Wild Type Neutralization Assay (wtVNA)

Neutralization assays against live SARS-CoV-2 were performed using the microneutralization assay as previously described (Bos et al., 2020), with the modification of a different strain used. Clinical isolate SARS-CoV-2/human/NLD/Leiden-0008/2020 (Leiden-0008) was isolated from a throat swab and passaged twice in Vero E6 cells. The NGS-derived complete genome of this virus isolate is available under GenBank accession number MT705206.1. Isolate Leiden-0008 was propagated and titrated in Vero E6 cells.

ELISpot

IFN-γ/IL-4 Double-Color was performed on freshly isolated PBMCs. PBMC were isolated from ethylene diamine tetraaceticacid (EDTA) whole blood using Ficoll gradient centrifugation (10 ml 92% Ficoll-Paque (GE Healthcare) Plus in 1:4 DPBS-diluted blood) The ELISpot was performed using the ImmunoSpot Human IFN-γ/I L-4 Double-Color Enzymatic ELISpot Assay Kit according to the manufacturer's protocol (Cellular Technology Limited). Ethanol-activated 96-well ELISpot plates were coated overnight with anti-human IFN-γ and IL-4 capture antibodies. Cells were plated at a concentration of 250,000 cells per well and stimulated with either cell culture medium in presence of DMSO, 2 pools of consecutive 15 mer peptides with 11 amino acid overlap (JPT) spanning the entire length of the SARS-CoV-2 S protein at a peptide concentration of 2 μg/mL, or 1 μg/mL PHA as positive control for 22 hours. Analysis was performed using the CTL ImmunoSpot Analyzer and ImmunoSpot Software (Cellular Technology). Spot-forming units per $1.0 \times 10^6$ PBMCs were calculated by subtraction of medium stimulus counts of the individual peptide pools per animal and summed across the 2 peptide pools.

Intracellular Cytokine Staining (ICS)

For analysis of intracellular cytokine production, $1 \times 10^6$ freshly isolated PBMC were stimulated at 37° C. overnight (approximately 15 hours) with either cell culture medium, 2 μg/mL SARS-CoV-2 S protein peptide pools (as described for ELISpot), medium or 1 μg/mL PHA in the presence of GolgiStop (BD Biosciences). Stimulated cells were first incubated with LIVE/DEAD Aqua viability dye (Invitrogen), followed by surface staining with anti-human monoclonal antibodies CD3-PerCP-Cy5.5, CD4-APC H7, CD8-BV650, CD14-BV605, CD69-BV786 (BD Biosciences) and CD2O-BV605 (Biolegend). Cells were subsequently fixed with Cytofix/Cytoperm buffer (BD Biosciences) and stained intracellularly with anti-human IL-2-PE, IFN-g-APC (BD Biosciences), IL-5-Vio515 (Miltenyi Biotec), IL-4-PE Dazzle594 and IL-13-BV421 (Biolegend). Sample acquisition was performed on a LSR Fortessa (BD Biosciences) and data were analysed in FlowJo V10 (TreeStar). Antigen-specific T cells were identified by consecutive gating on single cells (FSC-H versus FSC-A), live cells, size (lymphocytes) (FSC-A versus SSC-A), CD3+, CD4+ or CD8+ cells and CD69+ plus cytokine-positive (the gating strategy is shown in Supplementary FIG. 2). Cytokine-positive responses are presented after subtraction of the background response detected in the corresponding medium stimulated sample of each individual animal. Responders were defined by a technical threshold (Bowyer et al., 2018), the theoretical ability to detect at least 1 event in a cytokine gate and here defined as the reciprocal of the average number of CD4 or CD8 T cells of the medium and peptide pool stimulated samples for each assay run. Ratio of Th1 versus Th2 cytokines were calculated by Boolean gating of Th1 (CD4+ CD69+ T cells expressing IFN-γ or IL-2) and Th2 (CD4+ CD69+ T cells expressing IL-4 or IL-5 or IL-13) subsets. T cells expressing IL-4 or IL-5 or IL-13) subsets.

Statistical Analysis

ELISA and psVNA

For binding and psVNA neutralizing antibody data, comparisons between specific vaccine groups were made with the two-sample t-test in an analysis-of-variance (ANOVA). Successive time points have been compared with the paired t-test per vaccine group. p values were calculated on mean of log 10 transformed values.

wtVNA, ELISpot and ICS

Vaccine groups were compared to the negative control group with the Mann-Whitney U-test. Pairwise comparison between vaccine groups was performed using Tobit ANOVA with vaccine as factor if less than 50% of the titers are at LLOD. The pairwise comparisons between vaccines were done with the z-test. If for an assay any vaccine group had 50% censoring or more, then the pairwise comparisons were done with the Mann-Whitney U-test.

The difference in titer between consecutive time points was calculated per animal for each assay.

Depending on the number of censored measurements, the differences were compared with a Tobit ANOVA followed by a post-hoc z test or a sign test.

For all statistical tests the significance level was 5%. No multiple comparison adjustment was applied. All statistical calculations are done in SAS 9.4. (SAS Institute Inc., Cary, N.C., US).

Correlation Analysis

Correlation analysis between binding antibody concentrations and neutralizing antibody titers measured was calculated by two-sided Spearman rank-correlation test.

Results

Figure 1:
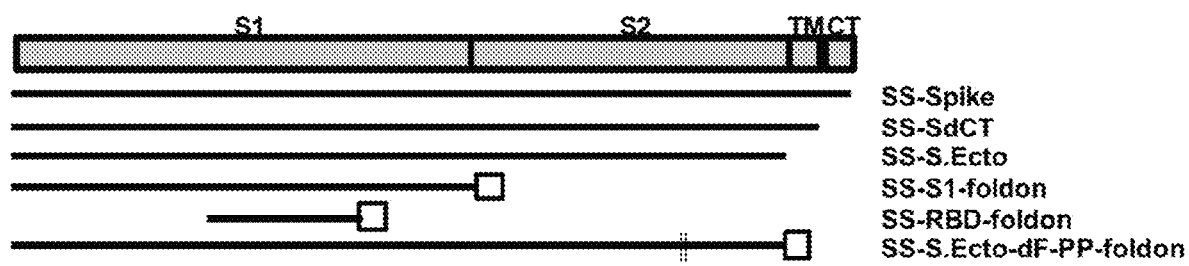
FIG. 1 is a diagram showing Spike protein immunogens. Annotated domains of 2019-nCoV Spike (SEQ ID NO: 1) including the S1 (SEQ ID NO: 4), S2 (amino acids 665-1191 of SEQ ID NO: 1), TM (SEQ ID NO: 86), and CT (SEQ ID NO: 85) domains. Full-length Spike (SEQ ID NO: 1), SdCT (SEQ ID NO: 2), S.Ecto (SEQ ID NO: 3), S1-foldon (SEQ ID NO: 9), RBD-foldon (SEQ ID NO: 10), and S.Ecto-PP-foldon (SEQ ID NO: 22) protein immunogens are labeled. White boxes indicate foldon domain and the double intersecting lines in S.Ecto-PP-foldon indicate the approximate position of two stabilizing mutations (proline substitutions corresponding to amino acids K969 and V970 of SEQ ID NO: 1).

Immunogenicity of One- and Two-Dose Ad26.COV2.S Vaccine Regimes in Adult Rhesus Macaques A cohort of 60 adult rhesus macaque (3.3-5.0 years old, 57 females and 3 males) was immunized with either a single dose of $1 \times 10^{11}$ vp or $5 \times 10^{10}$ vp Ad26.COV2.S at week 0 (n=14 per group) or with two-doses of $5 \times 10^{10}$ vp Ad26.COV2.S with a 4- or 8-week interval (n=14 per group). A sham control group (n=4) received saline injection at week 0 and week 8. S specific antibody responses were followed up every two weeks up to 14 weeks after the first immunization by enzyme-linked immunosorbent assay (ELISA) and pseudovirus neutralization assay (psVNA) and detected in all vaccinated animals as early as two weeks after immunization and significantly increased by week 4 post-immunization (p≤0.030, ANOVA t-test) (FIGS. 1A and B). Animals that received $1 \times 10^{11}$ vp Ad26.CoV2.S (group 2) had 1.6 fold higher binding- and 2-fold higher neutralizing antibodies (p=0.008 and p=0.004, respectively, ANOVA t-test) relative to animals immunized with $5 \times 10^{10}$ vp Ad26.CoV2.S (combined groups 3, 4 and 5). Similar differences in response levels were maintained across the observation period. S-binding antibody levels declined more rapidly than neutralizing antibody levels, irrespective of the vaccine dose the animals received.

A second vaccine dose, given at 4 or 8 weeks post the first vaccination, elicited a significant increase in S specific antibody responses (p≤0.001, ANOVA t-test) (FIGS. 117A and 117B) relative to the pre-dose 2 timepoint. Compared to a single immunization with $5 \times 10^{10}$ vp Ad26.COV2.S, a second immunization given at 4 and 8 weeks post first dose, elicited a 5.7- and 11.8-fold increase (p<0.001, ANOVA t-test) of binding antibody concentrations, and a 7.6- and 15.2-fold increase (p<0.001, ANOVA t-test) of neutralizing antibody titers, respectively, as measured 2 weeks post dose-2. Similar differences were observed when comparing the antibody responses elicited by the two-dose vaccine regimens, to those elicited by the single $1\times10^{11}$ vp vaccine dose.

While the two-dose vaccine regimens with 4- and 8-week interval elicited comparable S-specific binding antibody concentrations two weeks post second immunization, geometric mean of neutralizing antibody titers were 2.2-fold higher (p=0.005, ANOVA t-test) for the 8-week compared to the 4-week regimen. At week 4 and week 6 post second immunization, binding and neutralizing antibody levels declined in both two-dose groups with similar kinetics, maintaining the relative difference in neutralizing antibody magnitude (2.1- and 2.4-fold higher at 4- and 6-weeks respectively for the 8-week regime, p=0.021 and p=0.001, respectively, ANOVA t-test).

In spite of the more rapid decline of binding antibody titers relative to neutralizing antibody titers in animals that received a 1-dose regimen, we observed a good overall correlation between binding and neutralizing antibody levels across timepoints for all tested regimens (R=0.7875, p<0.001, Spearman rank-correlation test) (FIG. 117C).

Immunogenicity of One- and Two-Dose Ad26.COV2.S Vaccine Regimes in Aged Rhesus Macaques.

As COVID-19 severity and mortality is increased in the elderly, we also analyzed the immunogenicity of Ad26.COV2.S in aged rhesus macaques (20 females, 13.75-21.9 years old). An aluminum hydroxide (Al(OH)3) adjuvanted soluble trimeric spike protein stabilized in its prefusion conformation was included as a T helper 2 (Th2) skewing control vaccine. Groups were immunized with a one-dose regimen, given at week 0, of $1\times10^{11}$ vp Ad26.COV2.S (n=6), a two-dose regimen with $5\times10^{10}$ vp Ad26.COV2.S (n=6) or a two-dose regimen with Al(OH)3-adjuvanted 100 pg S protein (n=4) to promote Th2 type responses, 8 weeks apart. A sham control group received an Ad26 vector encoding an irrelevant antigen (Ad26.RSV.gLuc; sham control; n=4) at week 0 and week 8. SARS-CoV-2 S protein-specific binding and neutralizing antibody levels were measured every two weeks up to 10 weeks post the first immunization and S protein specific cellular responses were measured at 4 and 10 weeks.

S protein specific binding antibody concentrations significantly increased for each vaccination regimen from week 2 onwards (p≤0.034, ANOVA with post hoc paired t-test comparing week 0 versus week 2). At weeks 6 and 8 the Ad26.COV2.S-induced antibody concentrations were significantly increased compared to Al(OH)3-adjuvanted S protein-induced concentrations (p≤0.036, ANOVA with post hoc t-test). No statistically significant differences in antibody responses elicited by the two Ad26.COV2.S dose levels could be detected up to week 8. At week 10, 2 weeks after the second dose, the group that received a second dose of $5\times10^{10}$ vp Ad26.COV2.S had significantly higher antibody concentrations compared to recipients of the single dose $1\times10^{11}$ vp Ad26.COV2.S (4.4-fold for the $5\times10^{10}$ vp Ad26.COV2.S group, p=0.002) while S antibody concentrations were similar in recipients of the to the Al(OH)3-adjuvanted S protein (p=0.482) (FIG. 118A).

Kinetics of neutralizing antibody titers were determined by a wild-type virus neutralization assay. A single dose of $1\times10^{11}$ vp Ad26.COV2.S induced neutralizing antibody titers at week 2 which were significantly increased at week 4 in all animals compared to the previous timepoint (p=0.031, sign test), and remained stable thereafter up to week 10. Similarly the two-dose $5\times10^{10}$ vp Ad26.COV2.S regimen induced neutralizing antibody titers in all animals that significantly increased at week 4 (p=0.031, sign test) and 6 (p=0.008, to bit ANOVA with post hoc z-test) compared to previous timepoints. At week 10, 2 weeks after the second dose, antibody titers were increased 3-fold compared to week 8 (p<0.001, to bit ANOVA with post hoc z-test). Al(OH)3-adjuvanted S protein induced only low and transient levels of neutralizing antibodies after the first dose and in only 2 out of 4 animals. At week 10 however, 2 weeks after the second dose, all 4 animals had neutralizing antibodies in the same range as the Ad26.COV2.S groups (no statistical analysis possible due to small group size of the adjuvanted protein group). Pairwise comparison of vaccine groups at week 10 showed that the two dose $5\times10^{10}$ vp Ad26.COV2.S regimen induced significantly higher neutralizing antibody titers compared to the single dose $1\times10^{11}$ vp Ad26.COV2.S group (10-fold, p<0.00, to bit ANOVA and post-hoc z-test), while titers in NHP that received the S protein group were similar (p=0.303) (FIG. 118B). The S-specific binding IgG levels as measured with ELISA highly correlated with wild type neutralizing antibody titers (R=0.92, p=<0.001, Spearman rank correlation) showing a higher sensitivity of the ELISA (FIG. 118C).

S protein-specific T cell responses were measured with ELISpot and intracellular cytokine staining (ICS) using 15-mer peptides overlapping by 11 spanning the complete S protein. Both Ad26.COV2.S regimens as well as Al(OH)3-adjuvanted spike protein induced IFN-γ responses at 4 weeks after the first immunization (FIGS. 119A and 119B). Two weeks after the second dose of the $5\times10^{10}$ vp Ad26.COV2.S and adjuvanted spike protein group (week 10), IFN-γ responses were comparable for the $5\times10^{10}$ vp Ad26.COV2.S group to the week 4 time point, but lower for the $1\times10^{11}$ vp Ad26.COV2.S and adjuvanted S protein groups, suggesting that a second dose of Ad26.COV2.S gives better durability of T cell responses. Substantial IL-4 responses were observed only for the Al(OH)3-adjuvanted spike protein group at both week 4 and week 10 by ELISpot (FIG. 119A). CD4+ and CD8+ T cell cytokine responses were also analyzed by ICS. S protein-specific CD4+ T cell IFN-γ and IL-4 expression patterns confirmed the ELISpot responses, with all vaccine groups inducing significantly higher levels of IFN-γ compared to the sham control group at week 4 (p≤0.029, Mann-Whitney-U test) that decreased at week 10, except for the two dose $5\times10^{10}$ vp Ad26.COV2.S group which remained significantly higher compared to the sham group (p=0.010). IL-4 expression was only significantly higher for the Al(OH)3-adjuvanted spike protein group compared to the sham control group at both timepoints (p=0.029) (FIG. 119B). Additional cytokines IL-2, or IL-5 and IL-13 were measured and reflected the patterns as seen for IFN-γ or IL-4, respectively, with minimal or no boosting of responses for groups that received a second dose and only Al(OH)3-adjuvanted spike protein inducing robust levels of Th2 cytokines IL-4, IL-5 and IL-13 (FIG. 119C). This was confirmed by calculation of the Th1 versus Th2 ratio with a clear Th1 skewing observed after Ad26.COV2.S immunization independent of regimen (FIG. 119C). Spike protein-specific CD8+ T cells induced by Ad26.COV2.S mainly produced IFN-γ and IL-2, while Al(OH)3-adjuvanted spike protein only produced IL-2. None of the immunization regimens induced CD8+ T cells producing significant amounts of IL-4, IL-5 and IL-13 (FIG. 120).

In this Example, the immunogenicity of one- and two-dose Ad26.COV2.S regimens in adult and aged rhesus macaques for up to 14 weeks after the first dose was evaluated, to gain insight both in the durability of immunity after a single dose of the candidate vaccine and in the impact of a second dose on the magnitude of S protein specific immune responses.

In both adult and aged macaques, S binding and SARS-CoV-2 neutralizing antibody responses were detected as early as two weeks after the first immunization, which had significantly increased by week 4. The kinetics and magnitude of antibody responses appeared similar in adult and aged rhesus macaques for all Ad26.COV2.S vaccine regimens tested. These observations are in agreement with observations in adult and elderly humans at week 4 post single immunization with Ad26.COV2.S. Al(OH)3-adjuvanted S protein required 2 doses to elicit significant levels of neutralizing antibodies which also has been observed with other COVID-19 vaccines based on protein or mRNA platforms in Phase 3 clinical trials that were not sufficiently immunogenic after single dosing in NHP and humans (Corbett et al., The New England Journal of Medicine, 383(16), 1544-1555, 2020)(Guebre-Xabier et al., BioRxiv, 1-16, 2020). In both adult and aged NHP studies a high correlation between binding and neutralizing antibody responses was found, although different neutralization assays were used in the two studies. This suggests that S protein binding antibody ELISA could be used as a surrogate readout for neutralizing antibody responses, which is also supported by our earlier observations (Mercado et al., Nature. https://doi.org/10.1038/s41586-020-2607, 2020), In adult macaques, single dose Ad26.COV2.S elicited humoral immune responses were maintained at least up to week 14 post-immunization. Binding antibody responses did show some decline over time, while neutralizing antibody responses were more stably maintained, providing an early sign of durability of immunity elicited by our vaccine candidate. Humoral immune responses were slightly higher in NHP that received the $1\times10^{11}$ vp dose as compared to recipients of the $5\times10^{10}$ vp vaccine dose, but differences were too small to warrant use of the higher dose in further clinical development.

A second dose of Ad26.COV2.S given at 8 weeks post the first immunization resulted in a significant increase in spike protein-specific binding and more importantly neutralizing antibody responses, in both adult and aged NHP compared to the one-dose regimen. This is in line with observations with other Ad26-based vaccines, where a second dose always elicited a higher and more durable immune response in both animal models and humans. The findings for the two-dose Ad26.COV2.S regimen in NHP, suggest a two-dose Ad26.COV2.S vaccine regimen has the potential to result also in humans in higher and more durable immune responses as compared to our one-dose regimen.

Evaluation of the potential impact of length of interval between two vaccine doses in adult NHP, demonstrated that while levels of elicited binding antibody concentrations were similar after two doses with either a 4- or 8-week interval, the neutralizing antibody responses were higher in animals that received the two doses with an 8-week interval. Thus, a vaccine regimen with an 8 weeks intervals between 2 doses is preferred over a regimen with 4 weeks interval.

An important aspect to be evaluated when developing a COVID-19 vaccine is the potential and theoretical risk of Vaccine-Associated Enhanced Respiratory Disease (VAERD), which is generally considered to be associated with non-neutralizing antibody responses and Th2-skewed cellular immune responses. In this study it is shown that Ad26.COV2.S elicited CD4+T cell responses in aged NHP that were Th1-skewed, as previously shown in both adult NHP and adult and elderly humans, and similar to what has been found for other genetic vaccine platforms in NHP and humans utilizing the S protein antigen (van Doremalen et al., Nature, May. https://doi.org/10.1038/s41586-020-2608-y, 2020) (Yu et al., Science (New York, N.Y.), 369(6505), 806-811. https://doi.org/10.1126/science.abc6284, 2020) (Vogel et al., BioRxiv, 2020.09.08.280818. https://doi.org/10.1101/2020.09.08.280818, 2020)(Corbett et al., supra, 2020). In contrast, the Al(OH)3-adjuvanted S protein induced a more Th2 skewed immune response, as expected with this adjuvant, and confirming that a Th2 skewed response can be elicited in this NHP animal model. The Th1-skewed response in NHP together with the induction of robust and durable neutralizing antibody responses by Ad26.COV2.S, reduce the likelihood of VAERD for this vaccine.

In summary, these data show that a one- and two-dose Ad26.COV2.S vaccine regimen elicit similar antibody responses in adult and aged NHP. Importantly, a second vaccine dose administered 8 weeks post the first immunization, induced a significant increase in (neutralizing) antibody responses in both adult and aged animals compared to a single vaccine dose. In addition, the follow up of immunogenicity in adult macaques demonstrates that antibody responses are maintained up to 14 weeks post first immunization, providing an early indication of durable immune responses elicited by a single dose Ad26.COV2.S.

Example 27: Interim Results of a Phase 1/2a Trial with the Ad26.COV2.S Covid-19 Vaccine As described above, a multi-center Phase 1/2a randomized, double-blinded, placebo-controlled trial was designed in healthy adults (aged 18 to 55 years; cohort 1, n=405 or >65 years; cohort 3; n=405) receiving Ad26.COV2.S at a dose of $5\times10^{10}$ or $1\times10^{11}$ viral particles, in a single- or two-dose schedule (56 days interval).

In this Example, the results after first (cohort 1 and 3) and second (cohort 1) vaccination are reported.

Methods

Study Design and Participants

The study is a multicenter, randomized, double-blind, placebo-controlled Phase 1/2a trial to evaluate safety, reactogenicity and immunogenicity of Ad26.COV2.S at $5\times10^{10}$ (lower dose, LD) or $1\times10^{11}$ viral particles (vp) (higher dose, HD) in a 1 ml volume, administered intramuscularly (IM, deltoid muscle) as single-dose or two-dose schedule, 56 days apart, in healthy adults 18 to 55 years of age (cohort 1a: target n=375; cohort 1b (exploratory cohort for in-depth immunogenicity): target n=25; and >65 years of age (cohort 3: target n=375).

Ad26.COV2.S is a recombinant, replication-incompetent Ad26 vector encoding the full length and stabilized SARS-CoV-2 S protein derived from the first clinical isolate of the Wuhan strain (Wuhan, 2019, whole genome sequence NC_045512), as described in this patent application. The study is performed in Belgium and the United States and was reviewed and approved by local ethics committees and institutional review boards (IRB). All participants provided written informed consent before enrollment.

Procedures 405 eligible participants in both cohorts 1 and 3 were randomly assigned (1:1:1:1:1) in one of the following treatment arms: LD/LD; LD/placebo; HD/HD; HD/placebo, placebo/placebo for the first and second dose. Randomization was done by an Interactive Web Response System (IWRS) and stratified by site using randomly permuted blocks. Participants and investigators remain blinded at individual participant level throughout the study. To meet the criteria for study blinding, sponsor and statisticians were group-unblinded for the primary analysis of cohorts 1 and 3 only when all participants had reached day 8 post dose 2.

The primary endpoint was safety and reactogenicity of each dose schedule. Solicited adverse events (AEs) were collected on diary cards for 7 days post vaccination, unsolicited AEs for 28 days after vaccination and SAEs throughout the course of the study. AEs were graded according to FDA Guidance document "Toxicity Grading Scale for Healthy Adult and Adolescent Volunteers Enrolled in Preventive Vaccine Clinical Trials". Safety data are included up to the cut-off dates of 30 Oct. 2020 for cohort 1 and 3.

The secondary endpoint was humoral and cellular immunity to the SARS-CoV-2 S protein. At baseline and on Day 15, 29, 57 and 71, SARS-CoV-2 S-specific binding antibodies were measured by ELISA. Seropositivity was defined as a titer above the lower limit of quantification of the assay (lower limit of quantification [LLOQ]=50.3 EU/mL). SARS-CoV-2 serum neutralizing antibody titers were measured in a random subset of samples in a microneutralization wtVNA using the Victoria/1/2020 SARS-CoV-2 strain at Public Health England, with seropositivity defined as an IC50 titer >58 (LLOQ). IC80 wtVNA titers were also assessed at these timepoints. S-specific T-cell responses were measured at baseline and on Day 15 by ICS using two pools of S peptide pools of 15-mers overlapping by 11 amino acids. A Th1 response was characterized by CD4+ T cells expressing IFN-□ and/or IL-2 and not IL-4, IL-5 and/or IL13 and a Th2 response by expression of IL-4, IL-5 and/or IL-13 and CD40L. All assays were conducted in a blinded fashion and are described in detail in the supplementary materials.

Statistical Methods

Safety data were analyzed descriptively in the full analysis set and immunogenicity data were analyzed in the per protocol immunogenicity population. See supplementary materials and statistical analysis plan for further detail.

Results

Study Participants

The first vaccination of cohort 1 participants (age 18 to 55) was initiated on Jul. 22, 2020. By Aug. 7, 2020, 593 participants were screened, 405 enrolled and 402 immunized with their first dose and by Nov. 7, 2020 with their second dose in cohort 1 (1a and 1b combined. Immunization of cohort 3 participants (age >65) began on Aug. 3, 2020 and by Aug. 24 2020, 660 had been screened, 405 enrolled and 403 immunized with their first dose. Baseline seropositivity rates for SARS-CoV-2 S specific antibodies in cohort 1a and cohort 3 were 1.9% and 1.0%, respectively. Baseline characteristics were broadly similar across groups.

Vaccine Safety and Reactogenicity of Ad26.Cov2.S

Group-level unblinded safety data for both cohorts were collected and analyzed. Solicited AEs were collected on diary cards for 7 days post vaccination, unsolicited AEs for 28 days after vaccination and SAEs throughout the course of the study.

The investigator's assessment of reactogenicity post dose 1 is available for 402 participants in cohort 1 and for 403 in cohort 3. In both cohorts solicited local AEs were mostly grade 1 or 2, the most frequent being injection site pain. In cohort 1, solicited local AEs were found in 103 LD recipients (64%), 123 HD recipients (78%) and 7 (9%) given placebo. In cohort 3, solicited local AEs were reported in 66 LD recipients (41%), 68 HD recipients (42%) and 11 placebo recipients (14%) given placebo.

In both cohorts most solicited systemic AEs were grade 1 or 2, the most frequent being fatigue, headache, and myalgia. In cohort 1, solicited systemic AEs were reported in 105 LD recipients (65%), 133 HD recipients (84%) and 21 placebo recipients (26%). In cohort 3, solicited systemic AEs were reported in 74 LD recipients (46%), 88 HD recipients (55%) and 19 placebo recipients (23%). In cohort 1, grade 3 systemic AEs were reported in 15 LD recipients (9%) and in 32 HD recipients (20%) and none in the placebo group. Comparison of participants with one or more solicited grade 3 AEs in cohort 1a revealed 24%, 26% and 0% in the LD, HD and placebo groups, respectively in the 18-30 year age group, 3%, 14% and 0% in these groups for 31-45 year age group and 3%, 11% and 0% in these groups for the 46-55 year age group. In cohort 3, grade 3 systemic AEs were reported in 1 participant (0.6%) given the LD, in 4 (2.5%) given the HD and in none given placebo. In cohort 1, fever was reported in 25 LD recipients (15%) and 62 HD recipients (39%) and none in the placebo group, with grade 3 fever reported in 8 LD recipients (5%) and 15 HD recipients (9%). In cohort 3, fever was reported in 7 LD recipients (4%) and in 14 HD recipients (9%) with no grade 3 fevers in participants given the LD or placebo and in two HD recipients (1%). All fevers occurred within two days of immunization and resolved within one to two days with over 80% utilizing antipyretics at the onset of symptoms. In cohort 1, unsolicited AEs were reported in 34 (21%), 56 (35%) and 14 (17%) in the LD, HD and placebo groups, respectively. In cohort 3, unsolicited AEs were reported in 27 (17%), 38 (24%) and 13 (16%) participants in the LD, HD and placebo groups, respectively. No grade 4 AEs, solicited or unsolicited, were reported in any cohort.

In cohort 1a post dose two safety data is available on 363 participants. There were one or more solicited AEs in 77.0% and 79.7% of participants in the LD and HD groups, respectively, compared to 33.8 and 31.3% of participants receiving placebo as a second dose after a first dose of vaccine and 21.6% of placebos who just received placebo. In contrast to post dose 1 there were solicited AEs with worst grade 3 or higher in 1.4% and 6.8% of participants in the LD and HD groups, respectively with 1.4% and 1.5% in control groups who had previously received a first dose of vaccine and 0% of controls who had never received vaccine. There were no grade 3 fevers in any group following a second dose of vaccine.

No participant discontinued the study due to an AE. There were five SAEs: one hypotension judged by the investigator to be unrelated to vaccine because of a past history of recurrent hypotension, one bilateral nephrolithiasis in a participant with past medical history of kidney stones (not related), one not related case of legionella pneumonia, one worsening of multiple sclerosis, which was existing for approximately 8-10 years, based on the MRI findings, however it was only diagnosed after inclusion into the study (not related) and one participant with fever who was hospitalized overnight because of suspicion of Covid-19, who recovered within 12 hours, the fever was subsequently judged by the investigator to be vaccine related. For details see supplementary material.

Immunogenicity of Ad26.COV2.S

Immunogenicity data for this interim analysis were unblinded by dose level. In all 5 groups in cohort 1a, binding antibody concentrations (EU/mL GMCs) were measured against a stabilized SARS-CoV-2 full length Spike protein.

At baseline GMCs were <LLOQ, and had increased by Day 29 after vaccination to 478 (95% confidence interval: 379; 603), 586 (445; 771), 625 (505; 773) and 788 (628; 988) for the LD/placebo, LD/LD, HD/placebo and HD/HD groups, respectively, with >99% seroconversion in all groups (FIG. 121A). GMC further increased to 660 (513; 849), 754 (592; 961), 873 (701; 1087) and 1100 (908; 1332), respectively, by day 57. Post dose 1 seroconversion was 100% in all but the HD/placebo group (97%). 14 days following the second dose, the LD/LD and HD/HD groups reached a GMC of 1,677 (1,334; 2,109), and 2,292 (1,846; 2,845), respectively, with 100% seroconversion in each group. In the LD/placebo and HD/placebo groups, Day 71 GMCs (600 (443; 814) and 951 (696; 1,300), respectively) were similar to Day 57. In cohort 3, GMTs were <LLOQ at baseline. By Day 15 after vaccination with either the LD or HD, GMTs had increased to respectively 122 (97; 152) and 141 (114; 175), with 77% seroconversion rates in both dose groups (FIG. 121B). By Day 29, GMTs were 312 (246; 396) and 350 (281; 429) with 96% and 96% seroconversion rate.

SARS-CoV-2 neutralizing antibody titers (IC50) were measured by wtVNA in a random subset of participants from cohort 1a and 3. At baseline geometric mean titers (GMT) were <LLOQ, and increased by Day 29 after vaccination to 224 (158; 318), 224 (168; 298), 215 (16; 273) and 354 (220; 571) for the LD/placebo, LD/LD, HD/placebo and HD/HD groups in cohort 1a, respectively, with seroconversion rates of 96%, 88%, 96% and 92% (FIG. 121C). GMTs further increased by Day 57 to 310 (228; 422), 288 (221; 376), 370 (268; 511) and 488 (334; 714) for the LD/placebo, LD/LD, HD/placebo and HD/HD groups, with 100% seroconversion in the LD/Placebo group and 96% seroconversion in the other groups, respectively. 14 days following the second dose in cohort 1a, GMTs of 775 (508; 1183) and 1272 (746; 2169) were reached for the LD/LD and HD/HD groups, respectively, with 100% seroconversion in both dose groups (FIG. 121B, left panels). In the LD/placebo and HD/placebo groups GMTs at day 71 were 315 (227; 438) and 388 (290; 509), respectively, similar to day 57 GMTs. Both groups had 100% responders. In cohort 3, GMTs were <LLOQ at baseline and had increased to 212 (137; 284) and 171 (119; 269) at Day 15, and 277 (193; 307) and 212 (163; 266) at Day 29 for the LD and HD groups, respectively (FIG. 121D). The seroconversion rate was 92% at Day 15 for each dose level group, and 98% (83; 99) and 94% (76; 99) at Day 29 for the LD and HD group in cohort 3. These data were confirmed by IC80 wtVNA (FIG. 122). wtVNA and ELISA antibody levels were strongly correlated in both cohorts (FIG. 122A) albeit that the correlation has a wider elliptical shape in cohort 3, suggesting more variability in the relationship between the neutralizing and binding antibody titers in the older adults.

Antibody levels in the different human convalescent serum (HCS) panels that were included in assays for humoral immunity assessment run by different laboratories and in sera from vaccine recipients were in the same range.

Ad26 neutralizing antibodies at baseline or post dose 1 did not show any impact on the ability of the first and second immunization to induce SARS-CoV-2 neutralizing antibodies at day 29 and day 71 (post dose 2), respectively (FIG. 123).

Ad26.COV2.S elicited S-specific CD4+Th1 and Th2 responses and CD8+ T cell responses were characterized in a subset of participants at baseline and 15 days post dose 1. In cohort 1a, 76% (95% CI:65; 86) and 83% (73; 91) and in cohort 3 60% (46; 74) and 67% (53; 79) of LD and HD recipients, respectively had detectable Th1 responses to S peptides. Median CD4+Th1 responses to S peptides increased in cohort 1a from undetectable at baseline to a median of 0.08% (Q1; Q3:0.05; 0.16) and 0.11% (Q1; Q3:0.07; 0.16) 15 days post vaccination and in cohort 3 from non-detectable at baseline to a median of 0.09% (Q1; Q3:0.04; 0.17) and 0.11% (Q1; Q3:0.04; 0.15), for LD and HD recipients, respectively (FIG. 124A). One participant in cohort 1a (LD recipient) and one in cohort 3 (HD recipient) had a measurable Th2 response (FIG. 124B), but all participants with measurable Th1 and/or Th2 responses had a Th1/Th2 ratio well above 1.

Figure 122A:
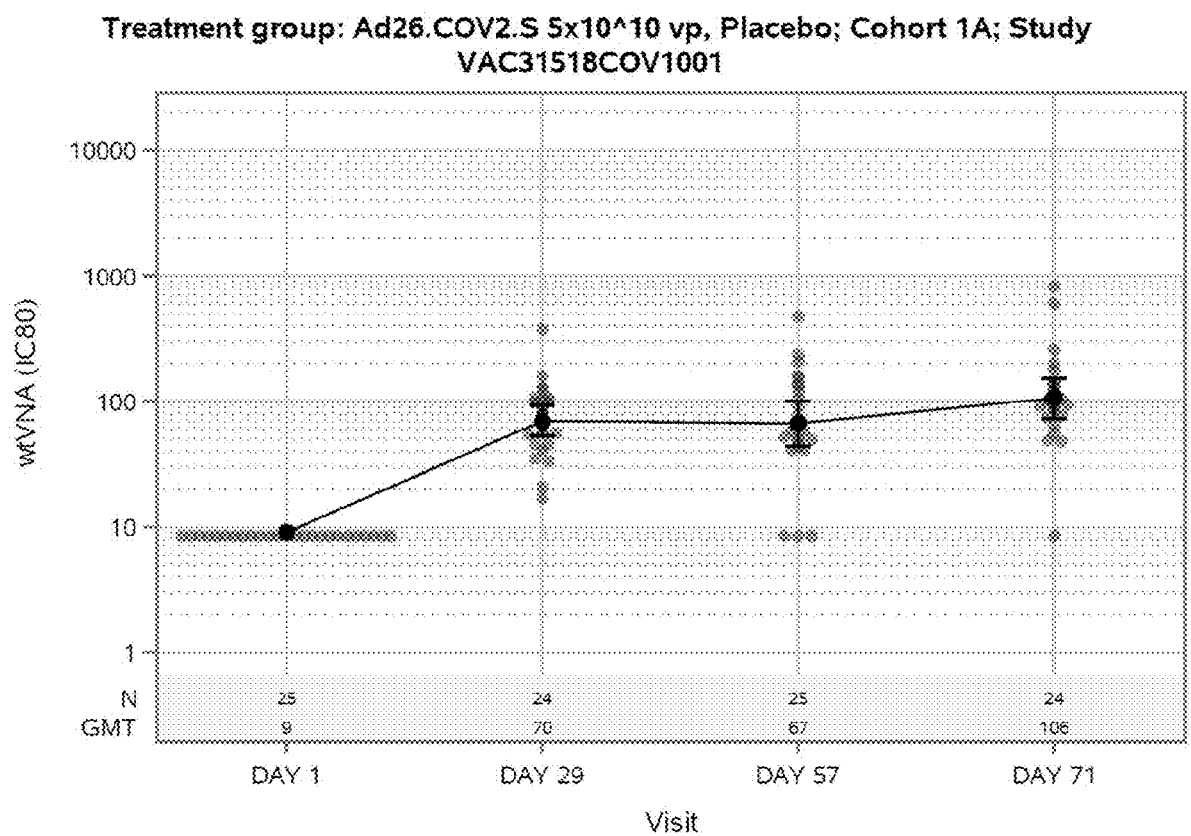
Figure 122B:
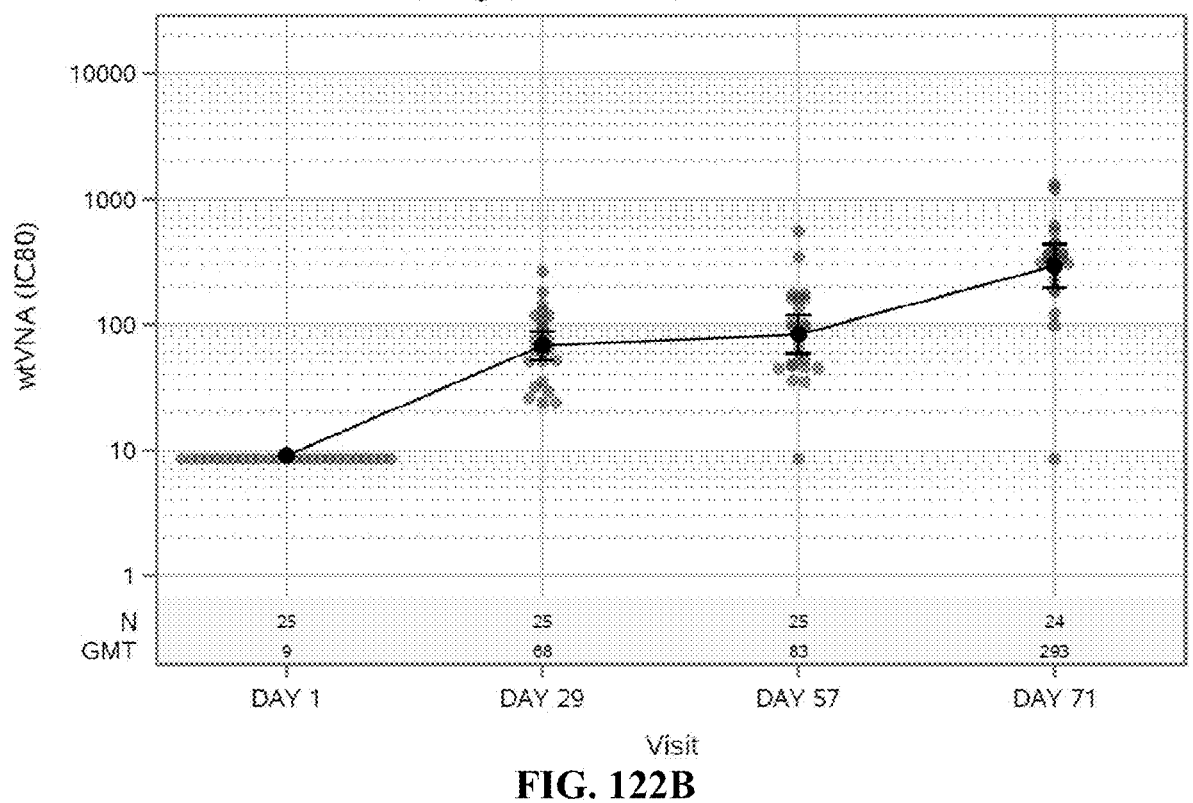
Figure 122C:
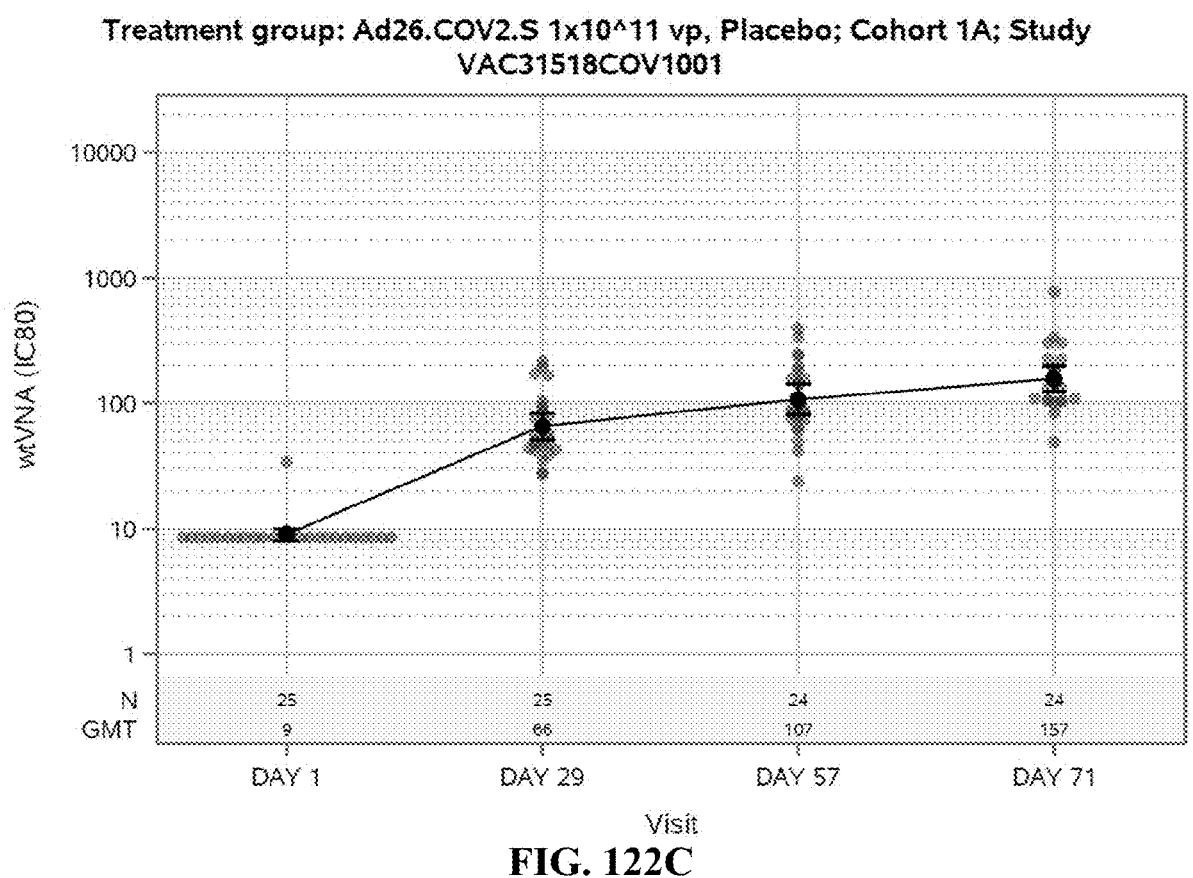
Figure 122D:
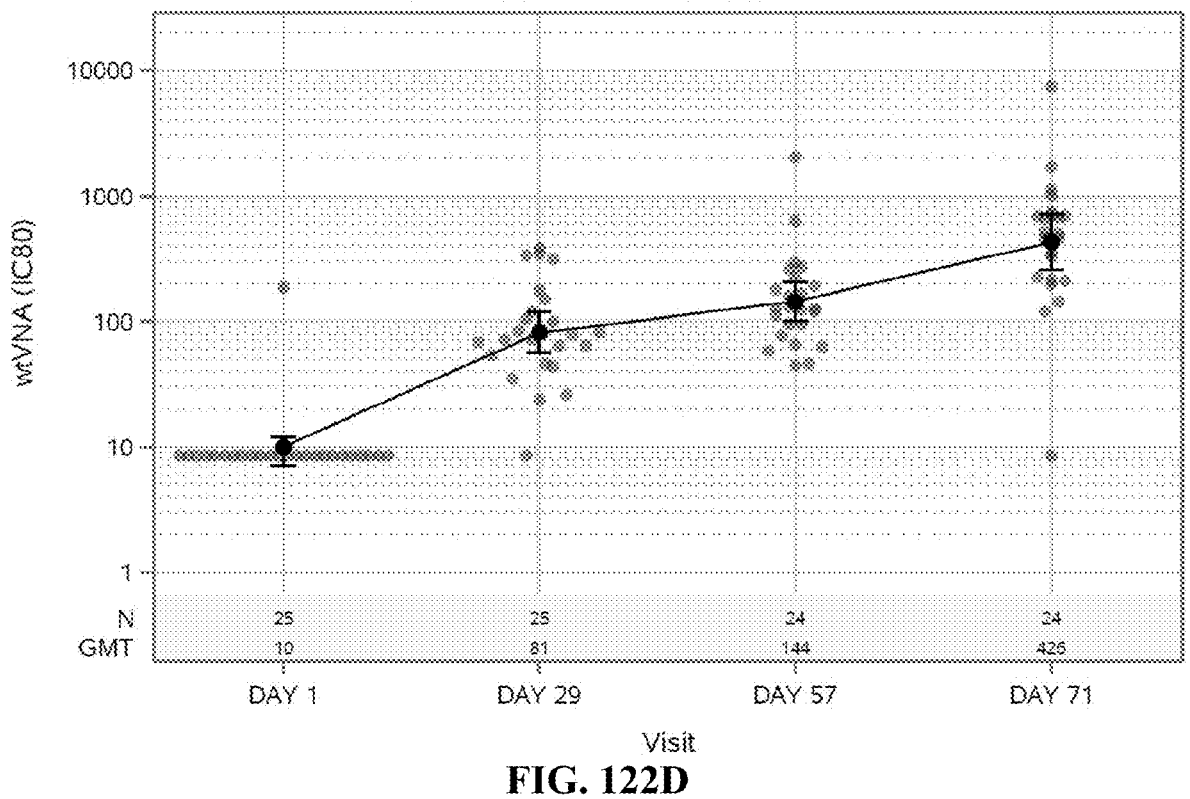
Figure 122E:
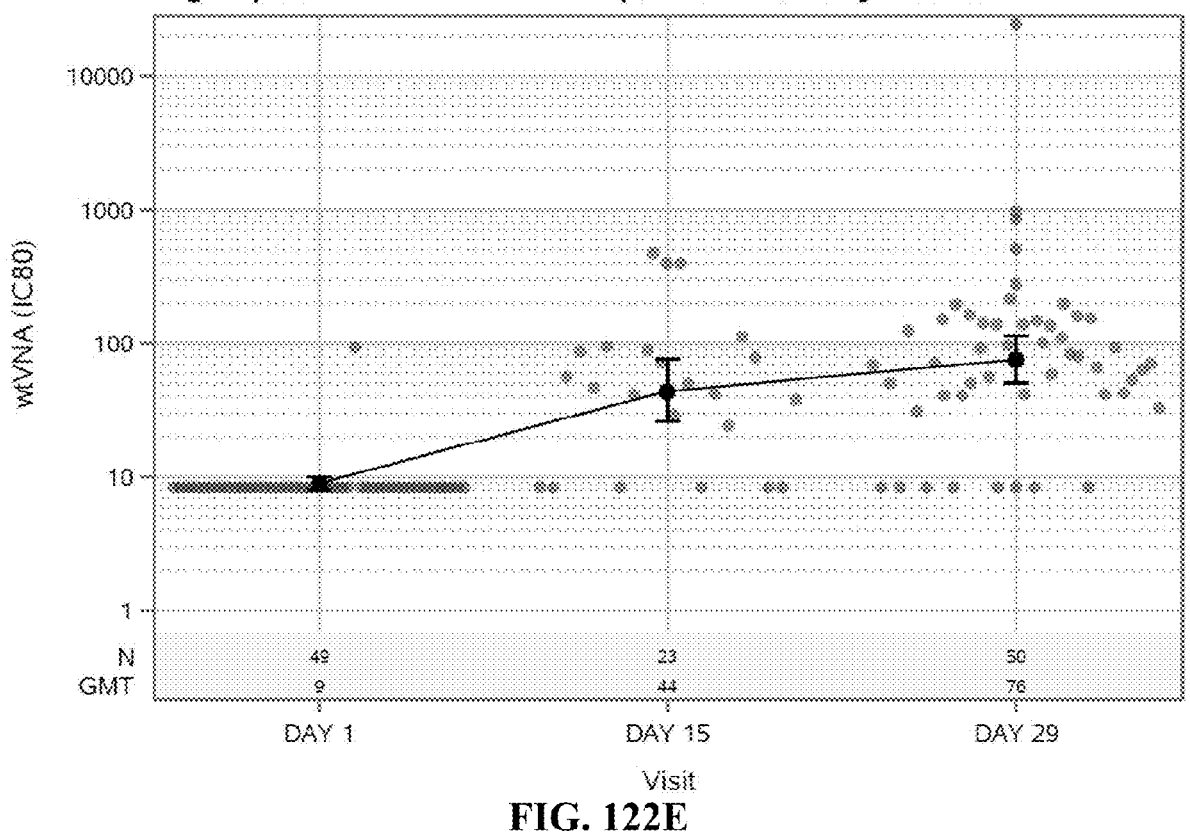
Figure 122F:
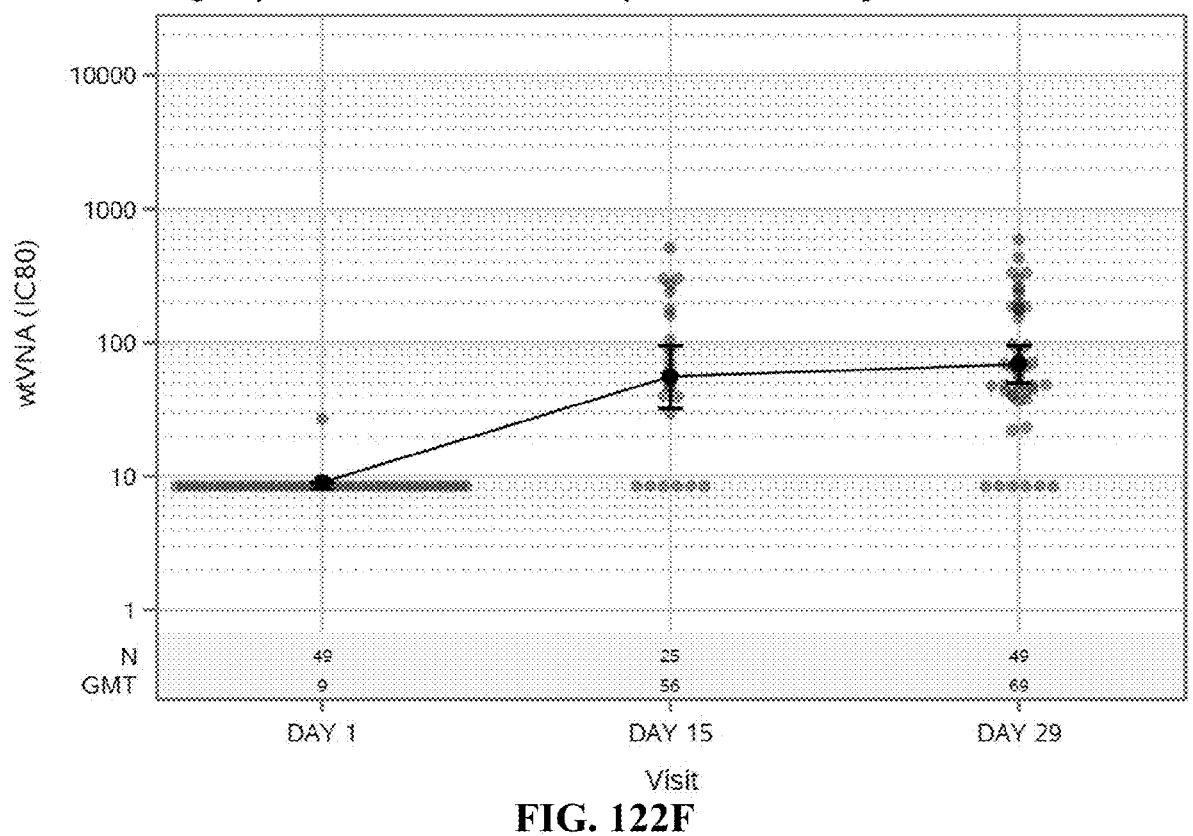

S-specific CD8+ T cell responses, as identified by the expression of IFN-γ and/or IL-2 cytokines upon S peptide stimulation (FIG. 124C), were absent at baseline in both cohorts. At day 15 post vaccination, 51% (95% CI: 39; 63) and 64% (95% CI: 52; 75) of cohort 1a participants had CD8+ T cell responses with a median magnitude of S-specific CD8+ T cell responses of 0.07% (Q1; Q3: 0.03; 0.19) and 0.09% (Q1; Q3: 0.05; 0.19) for the LD and HD groups, respectively. In cohort 3, CD8+ T cell responses were lower, with 36% (95% CI: 23; 51) and 24% (95% CI: 13; 37) responders with a median magnitude of 0.06% (Q1; Q3: 0.02; 0.12) and 0.02% (Q1; Q3:0.01; 0.08), for the LD and HD groups, respectively. The correlation between CD4+Th1 and CD8+ T cell responses was poor in both cohorts (FIG. 122B).

Conclusion

The interim analysis of this Phase 1/2a study shows that the vaccine candidate Ad26.COV2.S has an acceptable safety and reactogenicity profile and is immunogenic after a single vaccination with either a $5 \times 10^{10}$ or $1 \times 10^{11}$ vp dose. Post dose 1, there was a trend toward higher incidence of solicited systemic AEs with the higher vaccine dose level, a clear trend for decreasing grade 3 AEs with increasing age, the anticipated target population for efficacious Covid-19 vaccines. The local and systemic reactions occurred on the day of immunization or the next day and generally resolved within 24 hours. The systemic reactions were very responsive to antipyretics and there was no need for their prophylactic use. After the second dose in 18-55 years of age, the incidence of grade 3 solicited systemic AEs was much lower than after the first immunization for both the lower and higher vaccine dose, contrasting the observations with mRNA-based vaccines where the second dose seems to be associated with increased reactogenicity.

While all other Covid-19 vaccines currently in development require two doses, a single dose of Ad26.COV2.S elicited strong humoral responses in the vast majority of vaccine recipients, with S-binding and neutralizing antibodies in more than 90% of participants, irrespective of age group and vaccine dose. In addition, over the currently available follow-up time of 71 days post dose 1, antibody titers further increased and stabilized, suggestive for durability of Ad26.COV2.S elicited immune responses.

An efficacious single dose Covid-19 vaccine has obvious logistical advantages over a two-dose vaccine, especially for use in pandemic setting. It was observed here that a second vaccine dose in 18-55-year-old adults at day 57 further increased antibody titers, again in line with recent observations in NHP. Neutralizing antibody titers against the Ad26 vector, elicited by the first vaccination, did not correlate with the magnitude of post-dose 2 responses. Whether a second dose will be needed for either improved efficacy and/or durability in humans, is currently being studied in a phase 3 clinical trial.

The lack of standards and use of different assays complicates the comparison of performance of different Covid-19 vaccines in development. In addition, comparisons to HCS panels are rather arbitrary as different they have different GMTs, likely related to the composition of the panels (i.e. Covid-19 severity of the donors, time of sampling since their disease onset etc.). A theoretical risk for vaccine-associated enhanced respiratory disease (VAERD) has been associated with poorly neutralizing humoral immunity and Th2-skewed cellular immune responses. Here, all Ad26.COV2.S elicited CD4+ T cell responses were Th1 skewed, in line with previous experience with the Ad26-based vaccine platform. The accompanying consistent CD8+ T cell responses, albeit lower in older adults, and strong humoral responses further minimize the theoretical risk of VAERD.

In conclusion, our interim analysis indicates that Ad26.COV2.S is safe, well tolerated and immunogenic. Two ongoing Phase 3 studies are evaluating efficacy of either a single- or a two-dose regimen of $5 \times 10^{10}$ vp of Ad26.COV2.S.

Example 28: Productivity of Ad26.COV2.S

Productivity of Ad26.COV2.S (also referred to as Ad26NCOV030, Ad26COVS1), as defined by titers of virus particles per mL (VP/mL), is crucial for upscaling of vector production in bioreactors to provide sufficient material for the different down-stream process steps. Therefore, productivity was assessed in small-scale experiments by comparing the vaccine candidate vector to respective benchmark controls, of which performance in the 10-L process intensification (PIN)-bioreactor process is known.

Productivity of the Ad26NCOV030 vaccine candidate was tested together with Ad26NCOV028 in one experiment as these 2 constructs were initially both considered for the selection of the lead candidate. In brief, sPER.C6 and sPER.C6 TetR cells were transduced with 70 and 300 VP/cell of purified Ad26NCOV030 and Ad26NCOV028 material and two Ad26 benchmark controls, Ad26.ZEBOV and 26ZIK001 vectors (standard and low control, respectively). Samples were taken on Day 0, 1, 2, 3, and 4 post infection and Ad26 vector titers were determined by viral particles—quantitative polymerase chain reaction (VP-qPCR). As shown in FIG. 125A, productivity of Ad26NCOV030 in sPER.C6 cells was in between the low and standard control and higher than Ad26NCOV028, which was similar to the low control. Productivity in sPER.C6 TetR cells (FIG. 125B) was maximized for both Ad26NCOV030 and Ad26NCOV028 (both similar to the standard control). The results for the small scale productivity assessment were strengthened by 2 L bioreactor runs using PER.C6 and sPER.C6 TetR cells (Table below). These data demonstrated that Ad26NCOV028 and Ad26NCOV030 are both high producers on PER.C6 TetR cells in the 2L PIN platform and that Ad26NCOV028 and Ad26NCOV030 on PER.C6 cells are respectively lower than average, and average producers.

TABLE (Ad26NCOV030) and Ad26NCOV028 2 L bioreactor runs.

| Vector | Cell line | VP titer (VP/mL, VP-qPCR) | |
|---|---|---|---|
| | | Day 2 pi | Day 3 pi |
| Ad26NCOV028 | PER.C6 TetR | 1.78E12 | 5.70E12 |
| JNJ-78436735 | PER.C6 TetR | 3.10E12 | 6.14E12 |
| Ad26NCOV028 | PER.C6 | 1.14E11 | 5.57E10 |
| JNJ-78436735 | PER.C6 | 6.24E11 | 1.15E12 |

VP, viral particles; qPCR, quantitative polymerase chain reaction; TetR, tetracycline repressor;

Example 29: Ad26.COV2.S Elicited Immunity Protects Against 614G Spike Variant SARS-CoV-2 Infection in Syrian Hamsters and does not Enhance Respiratory Disease in Challenged Animals with Breakthrough Infection after Sub-Optimal Vaccine Dosing In this Example, an alternative SARS-CoV-2 hamster infection model is described which was utilized to confirm immunogenicity of Ad26.COV2.S and to establish its protective efficacy against intranasal infection with a 614G spike variant of SARS-CoV-2 (BetaCoV/Munich/BavPat1/2020). In non-vaccinated animals, infection with this virus resulted in infection of the upper and lower respiratory tract leading to mild to moderate disease based on histopathological findings. Ad26.COVS.2 elicited binding and neutralizing antibodies after a single dose that could be further increased with a second dose of vaccine after a 4 week interval. Ad26.COV2.S, elicited the highest level of antibodies and protection compared to two other Ad26-based COVID-19 prototype vaccines that were evaluated. A sub-optimal dose of Ad26.COV2.S elicited a humoral response that did not protect against viral replication in the lung after challenge but did not reveal evidence for VAERD as assessed by monitoring of respiratory viral replication and detailed histopathological analysis.

Materials and Methods
Vaccines

The Ad26-based vaccines were generated described herein. Briefly, they are based on a replication incompetent adenovirus serotype 26 (Ad26) vector encoding a prefusion stabilized SARS-COV-2 spike protein sequence (Wuhan Hu1; GenBank accession number: MN908947). Replication-incompetent, E1/E3-deleted Ad26-vectors were engineered using the AdVac system (Abbink et al., J. Virol. 81, 4654-4663 (2007)), using a single plasmid technology containing the Ad26 vector genome including a transgene expression cassette. The codon optimized, prefusion stabilized, SARS-COV-2 spike protein encoding gene was inserted into the E1-position of the Ad26 vector genome. Manufacturing of the Ad26 vectors was performed in the complementing cell line PER.C6 TetR (Wunderlich et al., Potent and short promoter for expression of heterologous genes. (2018)) (Zahn et al., PLoS One 7, 1-13 (2012)). The negative control vector Ad26.Irr (RSV-FA2-2A-GLuc) encodes the RSV F protein fused to Gaussia firefly luciferase as a single transgene separated by a 2A peptide sequence, resulting in expression of both individual proteins. Manufacturing of the vector was performed in PER.C6. Adenoviral vectors were tested for bioburden and endotoxin levels prior to use.

Study Design Animal Experiments
Hamster Studies

Animal experiments were approved by the Central Authority for Scientific Procedures on Animals (Centrale Commissie Dierproeven) and conducted in accordance with the European guidelines (EU directive on animal testing 86/609/EEC) and local Dutch legislation on animal experiments. The in-life phase took place at Viroclinics Biosciences BV. All Viroclinics personnel involved in performing the clinical observations and laboratory analysis in which interpretation of the data was required were not aware of the Treatment Allocation Key at any time prior to completion of the study and were blinded by allocating a unique sample number to each sample collected and analysis.

Male Syrian (golden) hamsters (*Mesocricetus auratus*), strain HsdHan:AURA, aged 9-11 weeks at the start of the study were purchased from Envigo ++++. Hamsters were immunized via the intramuscular route with 100 µl vaccine (50 µl per hind leg) under isoflurane anesthesia. Hamsters were intranasally inoculated with 100 µl containing $10^2$ $TCID_{50}$ of SARS-CoV-2 (BetaCoV/Munich/BavPat1/2020, containing a D614G substitution in the S1 fragment). The sequence of the challenge stock has been characterized and has been shown to be in line with the parental strain. On the day of infection, prior to inoculation, and daily until four days post infection throat swabs were collected under isoflurane anesthesia. Throat swabs were collected in virus transport medium, aliquoted and stored until time of analysis. Intermediate blood samples were collected via the retro-orbital bleeding route under isoflurane anesthesia. Blood was processed for serum isolation. At the end of the experiment, under anesthesia, animals were sacrificed by cervical dislocation and necropsy was performed. Respiratory tissues collected after necropsy were analyzed for viral load, and for histopathological changes.

Rabbit Studies

Rabbit experiments were approved by the local animal welfare body and conducted in concordance with European guidelines (EU directive on the protection of animals used for scientific purposes 2010/63/EU) and local Belgian legislation on animal experiments. The in-life phase took place at the non-clinical safety Beerse site of Janssen Research and Development, an AAALAC-approved laboratory. Female New Zealand White rabbits, aged approximately 4 months at the start of the study were purchased from Charles River Laboratories in France. Rabbits were immunized in week 0 and week 8 of the study with $5 \times 10^9$ or $5 \times 10^{10}$ vp Ad26.S, Ad26.dTM.PP or Ad26.COV2.S in a volume of 0.5 mL via the intramuscular route. As a control group, five rabbits were immunized with saline. Interim blood samples for serum processing were collected via the lateral ear. At the end of the experiment, animals were sacrificed by intravenous injection of Sodiumpentobarbital, followed by exsanguination via the femoral artery.

Histopathology

Histopathology was assessed by a pathologist from Viroclinics Biosciences BV and a pathologist from Janssen Non-Clinical Safety (Beerse, Belgium).

Four days p.i. all animals were autopsied by opening the thoracic and abdominal cavities and examining all major organs. The extent of pulmonary consolidation was assessed based on visual estimation of the percentage of affected lung tissue. The left nasal turbinates, trachea and left lung were collected for histopathological examination and analysis by IHC. All tissues were gently instilled with, and/or immersed in 10% neutral-buffered formalin for fixation. Lungs and trachea were routinely processed, paraffin wax embedded, micro-sectioned to 3 µm on glass slides and stained with haematoxylin and eosin (H&E) for histopathological evaluation. The sampled and fixed nasal turbinates were processed after decalcification and embedded into paraffin blocks, and similarly cut and stained. The H&E stained tissue sections were examined by light microscopy, using a Zeiss Axioplan or Leica DM2500 light microscope with magnification steps of 25×, 100×, 200×, and 400×, for histopathology scoring, as well as for the presence of any other lesions. The severity of inflammatory cell infiltration in nasal turbinates and tracheas was scored for rhinitis and tracheitis: 0=no inflammatory cells, 1=few inflammatory cells, 2=moderate number of inflammatory cells, 3=many inflammatory cells. For lung tissue, each entire slide was examined and scored for presence or absence of alveolar edema, alveolar hemorrhage and type II pneumocyte hyperplasia (0=no, 1=yes). The degree and severity of inflammatory cell infiltration and damage in alveoli, bronchi/bronchioles were scored for alveolitis and bronchitis/bronchiolitis: 0=no inflammatory cells, 1=few inflammatory cells, 2=moderate number of inflammatory cells, 3=many inflammatory cells. Extent of peribronchial/perivascular cuffing: 0=none, 1=1-2 cells thick, 2=3-10 cells thick, 3=over 10 cells thick. Additionally, the extent of alveolitis/alveolar damage was scored per slide: 0=0%, 1=<25%, 2=25-50%, 3=>50%.

The cumulative score (sum) for the extent and severity of inflammation of lung tissues provided the total lower respiratory tract (LRT) score, with a possible maximum score of 24. The following histopathology parameters were included in the sum of lower respiratory tract disease parameters: alveolitis, alveolar damage, alveolar edema, alveolar hemorrhage, type II pneumocyte hyperplasia, bronchitis, bronchiolitis, peribronchial and perivascular cuffing.

Immunohistochemistry

Lung, nose and trachea tissue samples were sampled, fixed in 10% formalin (lung instilled) for 14 days and were embedded in paraffin by Viroclinics Biosciences B.V. Tissue blocks were delivered and assessed by a pathologist from Janssen Non-clinical Safety (Beerse, Belgium). Paraffin sections of lung, trachea and nose sections of all animals were automatically stained (Ventana Discovery Ultra, Roche, France), using rabbit polyclonal anti-SARS-CoV Nucleocapsid protein antibody (NP, Novus NB100-56576, 1/300) which is cross reactive towards SARS-CoV-2 NP. These sections were semi-quantitatively scored for number of immunoreactive cells, and graded as 0: no positive immunoreactive cells, 1: minimal (few/focal) number of positive cells, 2 moderate (focal/multifocal) number of positive cells and 3: many/high (focally extensive/multifocal) number of immunoreactive cells.

Virus Neutralization Assay

Neutralization assays against live SARS-CoV-2 were performed using the microneutralization assay previously described by Algaissi and Hashem (Algaissi & Hashem, Evaluation of MERS-CoV Neutralizing Antibodies in Sera Using Live Virus Microneutralization Assay in 107-116 (2020). doi:10.1007/978-1-0716-0211-9_9). Vero E6 cells [CRL-1580, American Type Culture Collection (ATCC)] were grown in Eagle's minimal essential medium (EMEM; Lonza) supplemented with 8% fetal calf serum (FCS; Bodinco BV), 1% penicillin-streptomycin (Sigma-Aldrich, P4458) and 2 mM L-glutamine (PAA). Cells were maintained at 37° C. in a humidified atmosphere containing 5% CO2. Clinical isolate SARS-CoV-2/human/NLD/Leiden-0008/2020 (Leiden L-0008) was isolated from a nasopharyngeal sample and its characterization will be described elsewhere (manuscript in preparation). The next-generation sequencing derived sequence of this virus isolate is available under GenBank accession number MT705206 and shows 1 mutation in the Leiden-0008 virus compared to the Wuhan sequence resulting in Asp>Gly at position 614 (D614G) of the Spike protein. Isolate Leiden-0008 was propagated and titrated in Vero E6 cells using the TCID50 endpoint dilution method. The $TCID_{50}$ was calculated by the Spearman-Karber algorithm as described (Hierholzer & Killington, Virology Methods Manual—Virus isolation and quantitation (1996).doi:10.1016/6978-0-12-465330-6.X5000-3) All work with live SARS-CoV-2 was performed in a biosafety level 3 facility at Leiden University Medical Center.

Vero-E6 cells were seeded at 12,000 cells/well in 96-well tissue culture plates 1 day prior to infection. Heat-inactivated (30 min at 56° C.) serum samples were analyzed in duplicate. The panel of sera were 2-fold serially diluted in duplicate, with an initial dilution of 1:10 and a final dilution of 1:1280 in 60 µL EMEM medium supplemented with penicillin, streptomycin, 2 mM L-glutamine and 2% FCS. Diluted sera were mixed with equal volumes of 120 $TCID_{50}$/60 µL Leiden-0001 virus and incubated for 1 h at 37° C. The virus-serum mixtures were then added onto Vero-E6 cell monolayers and incubated at 37° C. in a humidified atmosphere with 5% CO2. Cells either unexposed to the virus or mixed with 120 $TCID_{50}$/60 µL SARS-CoV-2 were used as negative (uninfected) and positive (infected) controls, respectively. At 3 days post-infection, cells were fixed and inactivated with 40 µL 37% formaldehyde/PBS solution/well overnight at 4° C. The fixative was removed from cells and the clusters were stained with 50 µL/well crystal violet solution, incubated for 10 minutes and rinsed with water. Dried plates were evaluated for viral cytopathic effect. Neutralization titer was calculated by dividing the number of positive wells with complete inhibition of the virus-induced cytopathogenic effect, by the number of replicates, and adding 2.5 to stabilize the calculated ratio. The neutralizing antibody titer was defined as the log 2 reciprocal of this value. A SARS-CoV-2 back-titration was included with each assay run to confirm that the dose of the used inoculum was within the acceptable range of 30 to 300 $TCID_{50}$.

ELISA

IgG binding to SARS-CoV-2 Spike antigen was measured by ELISA with the full-length in house produced Spike protein COR200099 (hamster studies), or COR200153 (rabbit study). COR200099 is an in-house produced SARS-CoV-2 Spike protein, stabilized by two point mutations in the S1/S2 junction that knocks out the furin cleavage site, and by two newly introduced prolines in the hinge region in S2. In addition, the transmembrane and cytoplasmic regions have been replaced by a foldon domain for trimerization mutations, allowing the protein to be produced as soluble protein. COR200153 an in-house produced SARS-CoV-2 Spike protein based on the Wuhan-Hu-1 SARS-CoV-2 strain (MN908947) and stabilized by two point mutations (R682A, R685G) in the S1/S2 junction that knocks out the furin cleavage site, and by two consecutive prolines (K986P, V987P) in the hinge region in S2 and A942P. In addition, the transmembrane and cytoplasmic regions have been replaced by a fibritin foldon domain for trimerization. The protein is C-terminally biotinylated via a sortase A reaction. For hamsters, 96-wells Perkin Elmer white 1/2 area plates were coated overnight with protein.

For rabbits, plates were incubated for 2 hours at 37° C. for coating. Following incubation, plates were washed, blocked for 1 hour and subsequently incubated for 1 hour with 3-fold serially diluted serum samples in block buffer in duplicate. After washing, plates were incubated for 1 hour with Rabbit-Anti-Hamster IgG HRP (Invitrogen, catalogue number A18895) or anti-rabbit IgG-HRP (Jackson ImmunoResearch) in block buffer, washed again and developed using ECL substrate. Luminescence readout was performed using a BioTek Synergy Neo instrument (hamster samples) or on an Envision Multimode plate reader (rabbit samples). Hamster antibody titers are reported as Log 10 endpoint, rabbit titers are reported as Log 10 relative potency compared to a reference standard.

Statistical Analysis

Statistical differences across dose levels between immunization regimens were evaluated two-sided for S-specific binding antibodies as measured by ELISA, neutralizing titers as measured by virus neutralization assay (VNA), viral load as measured by $TCID_{50}$, histopathology and IHC scores. Across dose levels comparisons between Ad26.S, Ad26.dTM.PP and Ad26.COV2.S groups were made using the t-test from ANOVA with vaccine and dose as factors for measurements without censoring at LLOD or LLOQ, or the z-test from Tobit ANOVA for measurements at most 50% censored, or the Cochran-Mantel-Haenszel test for measurements at least 50% censored. Results were corrected for multiple comparisons by 3-fold Bonferroni correction. Exploratory comparisons per dose level, and across dose level of Ad26.S, Ad26.dTM.PP and Ad26.COV2.S groups with groups immunized with an irrelevant antigen, Ad26.Empty and Ad26.Irr, were made using the methods above or the Mann-Whitney U test. Due to the exploratory nature of these analysis, results were not corrected for multiple comparisons.

Statistical analyses were performed using SAS version 9.4 (SAS Institute Inc. Cary, N.C., US) and R version 3.6.1 (2019-07-05). Statistical tests were conducted two-sided at an overall significance level of $\alpha=0.05$.

Correlation Analysis

Hamsters were classified either as infected or protected from SARS-CoV-2, defined as a lung viral load of either above or below 102 $TCID_{50}$/g, respectively. From the binding and neutralizing antibody data pooled from different regimens and dose levels of Ad26.COV2.S, logistic regression models were built with Firth's correction, with protection outcome as the dependent variable, and the wtVNA and Log 10 transformed ELISA data before inoculation as the independent variable.

Results

Establishment of an Alternative SARS-CoV-2 Syrian Hamster Challenge Model.

Figure 126A:
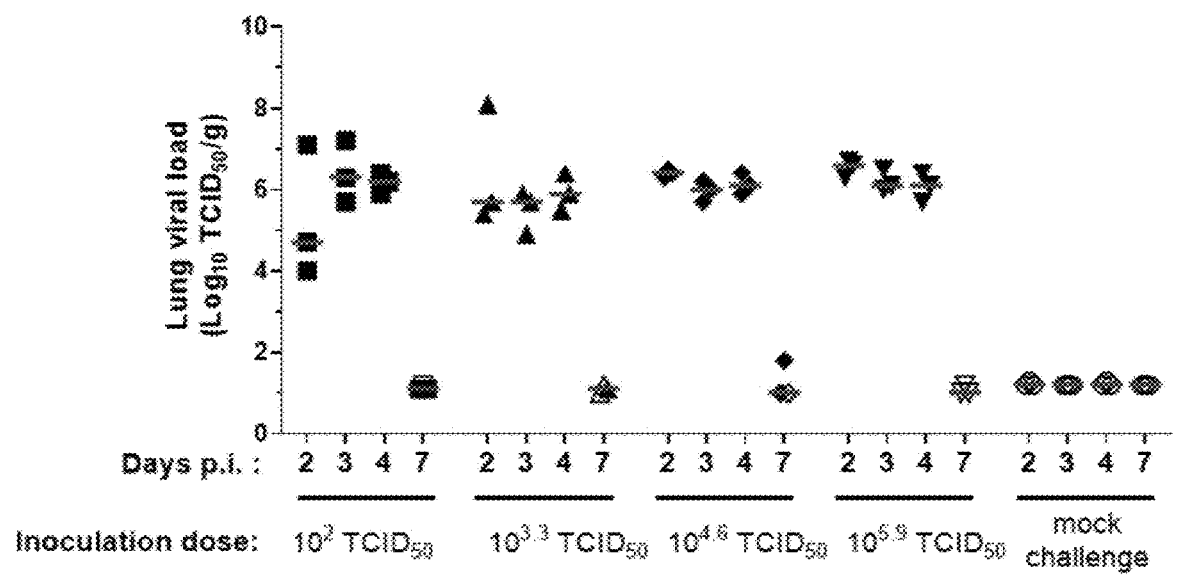
Figure 126B:
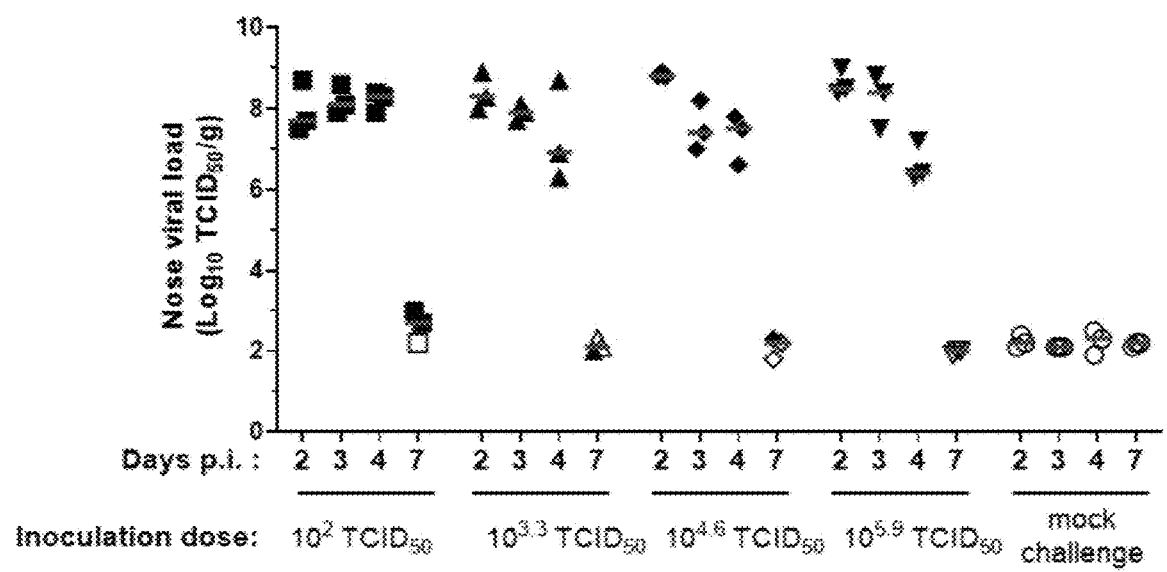
Figure 126C:
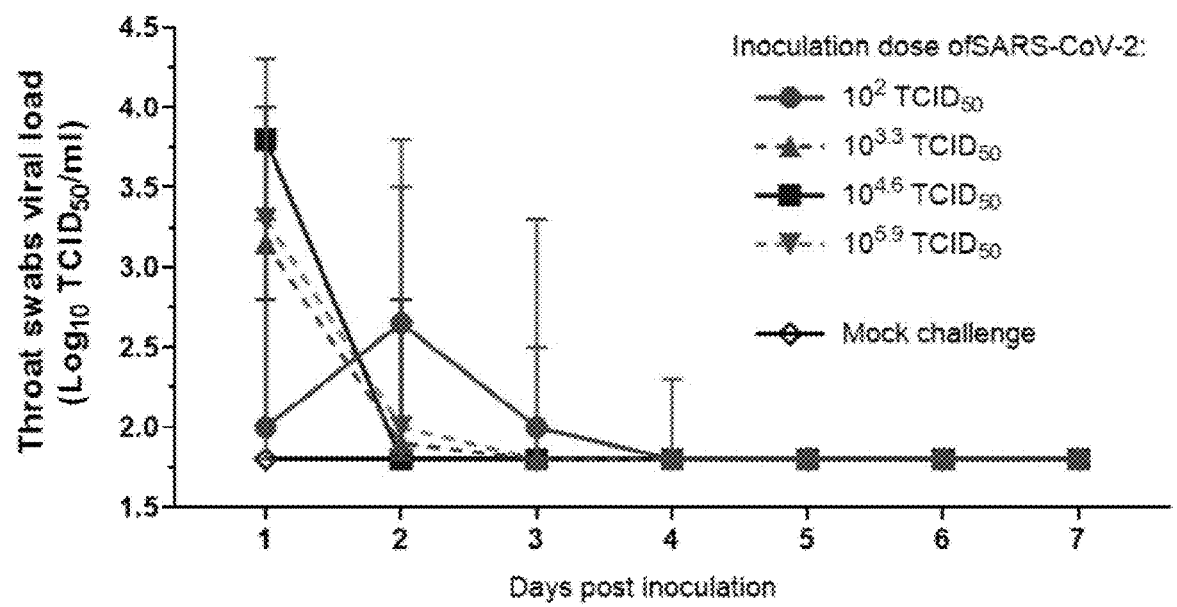
Figure 126D:
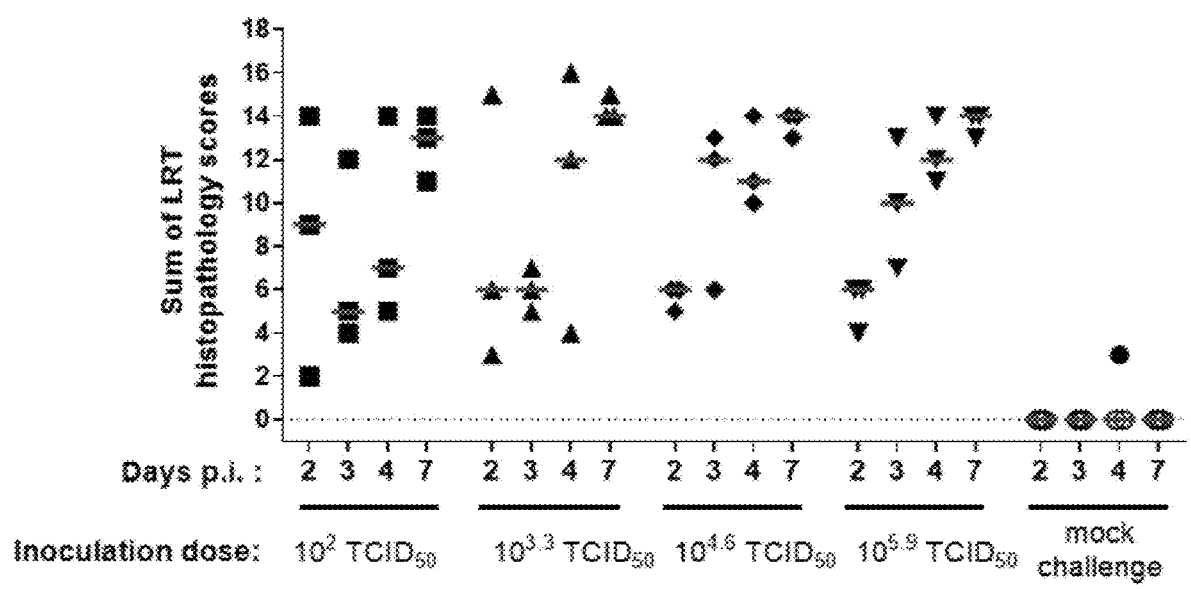
Figure 126E:
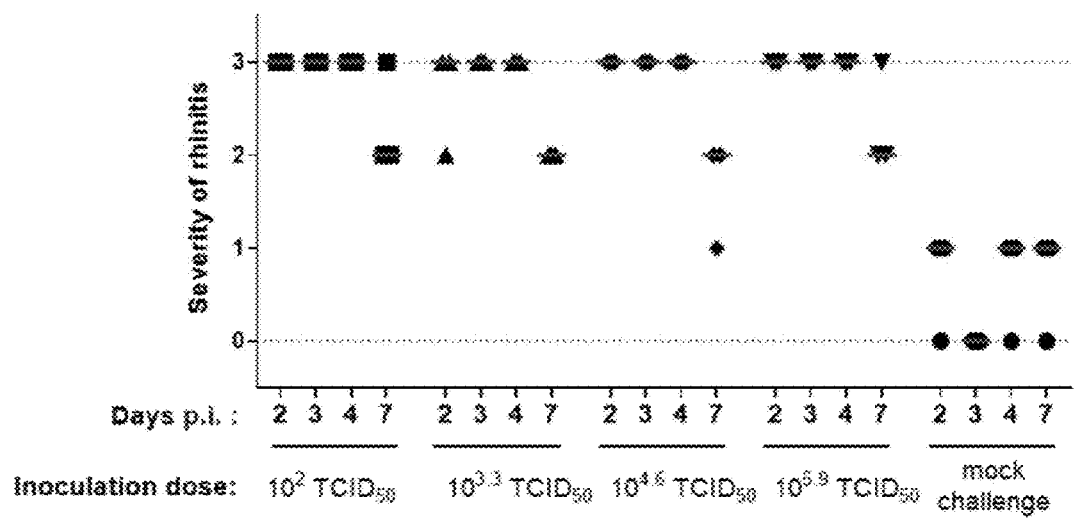

To assess vaccine immunogenicity, efficacy, and VAERD in hamsters we established an alternative Syrian hamster challenge model based on a SARS-CoV-2 strain with predominantly the D614G substitution in the spike protein. Male animals (n=12 per inoculation dose level) were inoculated with SARS-CoV-2 BetaCoV/Munich/BavPat1/2020 (containing a D614G substitution in the S1 fragment) at dose levels $10^2$, $10^{3.3}$, $10^{4.6}$ and $10^5$.9 50% tissue culture infective dose ($TCID_{50}$) administered by the intranasal route. Daily throat swabs were taken and necropsies were performed 2, 3, 4, and 7 days post inoculation (dpi) (n=3 per timepoint), to monitor viral load in throat swabs, in lung and nose tissue, and to study respiratory tract pathology. As shown in FIGS. 126A and B, lung and nose tissue viral load assessment revealed high titers of replication competent virus as measured by $TCID_{50}$ in all inoculated animals at 2 dpi, independent of the size of the inoculum. The observed lung and nose viral load kinetics after 2 dpi were comparable across all tested inoculum quantities. Hamsters inoculated with $10^{3.3}$, $10^{4.6}$ and $10^{5.9}$ $TCID_{50}$ showed highest viral loads in throat swabs at one dpi (FIG. 126C), after which viral loads decreased to below the limit of detection by maximal five days post inoculation (dpi). By contrast, inoculation with the lowest SARS-CoV-2 dose of $10^2$ $TCID_{50}$ resulted in an increase in infectious viral load from one to two dpi, suggesting lung replication, after which the viral load decreased to below the limit of detection by day 4 post inoculation.

Histological analysis after challenge with $10^2$ $TCID_{50}$ showed abundant presence of SARS nucleocapsid protein antigen (SARS-CoV-2 NP) by immunohistochemistry in areas of severe inflammation, characterized by multifocal moderate to severe degeneration and necrosis of upper and lower respiratory tract epithelial cells (data not shown). Compared with the higher challenge doses, $10^2$ TCID$_{50}$ induced a comparable extent and severity of inflammation and damage throughout the respiratory tract, as determined by blinded semi-quantitative scoring (FIGS. 126D and E), with marginally lower lung histopathology scores at lower dose levels. Taken together, these results demonstrate that a low dose challenge inoculum induced a comparable viral load and disease pathology compared with higher viral dose challenges. For subsequent experiments we selected a $10^2$ TCID$_{50}$ challenge dose associated with mild to moderate disease based on histopathology findings, so that the occurrence of more severe disease could be detected in this model and a theoretical risk for VAERD addressed. A 4-day follow up time after challenge was chosen as the most optimal time point to simultaneously evaluate lung tissue viral load and histopathology.

Immunogenicity of Ad26.COV2.A in Syrian Hamsters.

Immunogenicity and protective efficacy of our Ad26.COV2.S vaccine candidate was assessed in the newly established challenge model described above. For comparison, two prototype Ad26 based vaccines were used expressing a membrane bound full length wild-type spike protein (Ad26.S) or a soluble pre-fusion stabilized spike protein with a C-terminal foldon replacing the transmembrane domain (Ad26.dTM.PP). Hamsters were immunized with either $10^9$ or $10^{10}$ viral particles (VPs) of Ad26.COV2.S and the two prototype vaccines. For each dose level, immunogenicity was assessed at various timepoints after single dose, and after a second homologous dose given in week 4. Animals were challenged 4 weeks after last vaccine dose (FIG. 127A). At week 4, Ad26.COV2.S elicited the highest neutralizing antibody titers and frequency of responding animals across dose levels (median titer $10^9$ VP 22.6, $10^{10}$ VP 38.6; 12/12 responders) compared with Ad26.S (median titer $10^9$ VP 8.5, $10^{10}$ VP 9.7; 8/12 responders, p<0.001) and Ad26.dTM.PP (median titer $10^9$ VP 8.5, $10^{10}$ VP 16.0; 8/12 responders, p<0.001) (FIG. 127B). A second dose, irrespective of vaccine used, increased neutralization titers (week 8; FIG. 127C). The Ad26.COV2.S vaccine was most immunogenic also after two doses, with a median neutralization titer of 128 after two doses of $10^9$ VP and 219 after two doses of $10^{10}$ VP, compared to respectively 32 and 55 for Ad26.S (p=0.003), and 16 and 61 for A26.dTM.PP (p=0.002).

Binding antibodies measured by ELISA showed the same differences between Ad26.COV2.S and the two prototype vaccines (FIG. 128A), which is reflected by comparable neutralizing over binding antibody titer ratios (FIGS. 128B and C). However, a second dose at week 4 only transiently increased the median binding antibody titers at week 5 (FIG. 128A). Antibody titers subsequently declined and at week 8 were comparable to levels observed prior to dose 2 at week 4 or lower.

We confirmed the immunogenicity of Ad26.COV2.S and the two prototype vaccines and the benefit of a second dose in rabbits in a 2-dose regimen using an 8-week interval, an interval that is also being evaluated in clinical studies. Vaccines were tested at a dose level of 5×10$^9$ and 5×10$^{10}$ VPs, of which the latter represents the human dose used in phase 3 clinical trials. All tested vaccines elicited binding and neutralizing antibody titers as early as 2 weeks after the 1st dose with Ad26.COV2.S again inducing higher antibody titers compared to both Ad26.S and Ad26.dTM.PP (Supp FIGS. 129A and B). A second homologous dose at week 8 significantly boosted the binding and neutralizing antibody titers at week 10 (2 weeks post second dose) when compared across dose to pre-second dose levels (p<0.001).

Protective Efficacy of Ad26.COV2.S Against SARS-CoV-2 Challenge in Syrian Hamsters.

Next, we studied the protective efficacy of Ad26.COV2.S and the two prototype vaccines administered as 1- or 2-dose regimens followed by an intranasal inoculation with $10^2$ TCID$_{50}$ of SARS-CoV-2 D614G virus 4 weeks after the last dose i.e., at week 4 for the 1-dose regimen and at week 8 for the 2-dose regimen in Syrian hamsters. At 4 dpi, animals were sacrificed, and lungs, nasal turbinates and throat swabs analyzed for viral load and pathological changes. To increase the power of the statistical analysis and since we did not observe a pronounced dose responsiveness for the virology readouts, we pooled viral load readouts for comparison to the Ad26.Empty control group. Comparisons between the three different vaccines (Ad26.COV2.S, Ad26.S, Ad26.dTM.PP) were conducted across dose levels.

Figure 130A:
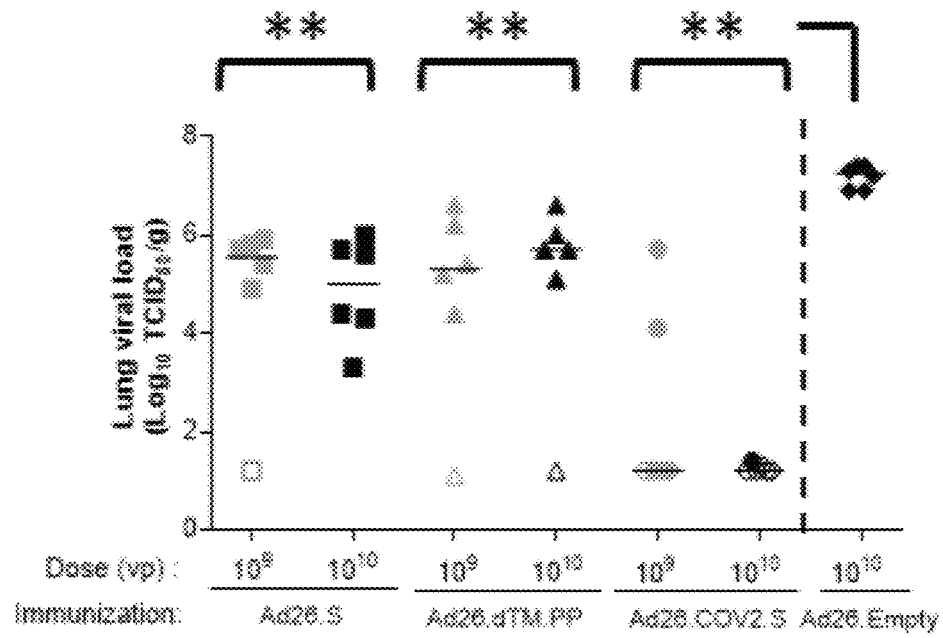
Figure 130B:
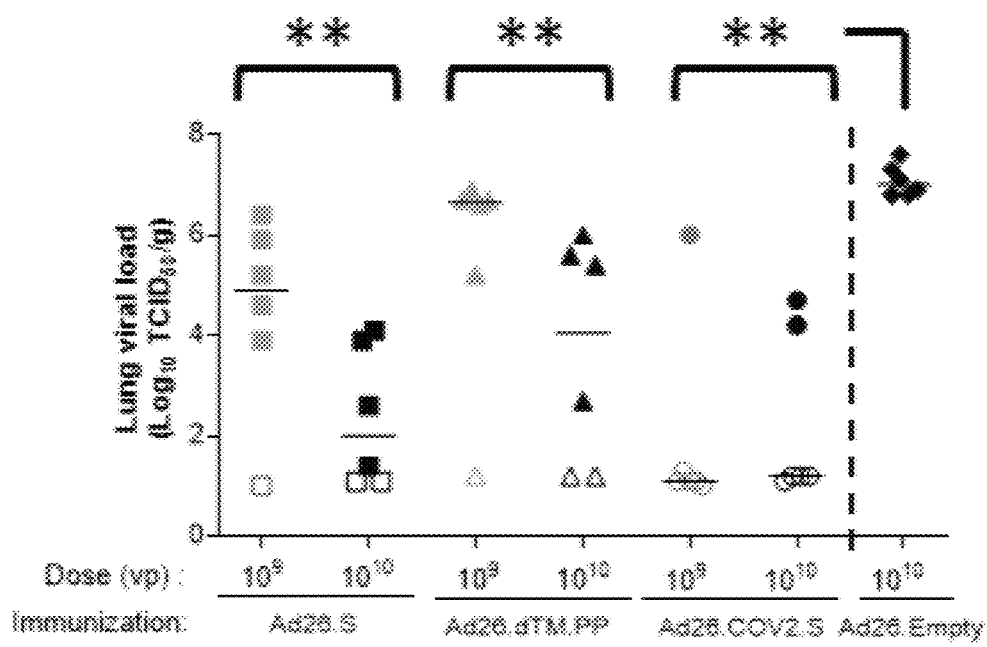
Figure 130C:
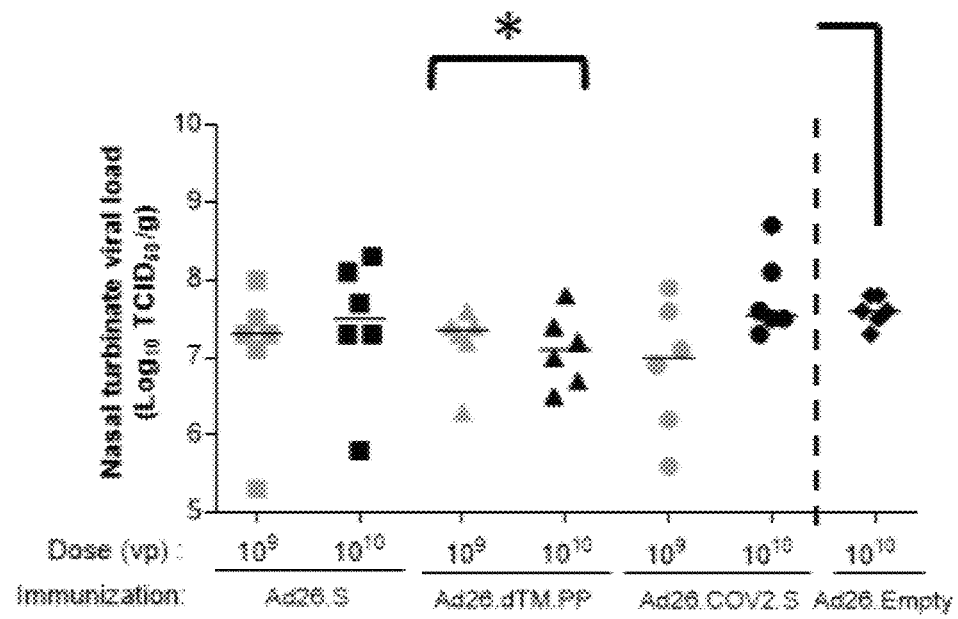
Figure 130D:
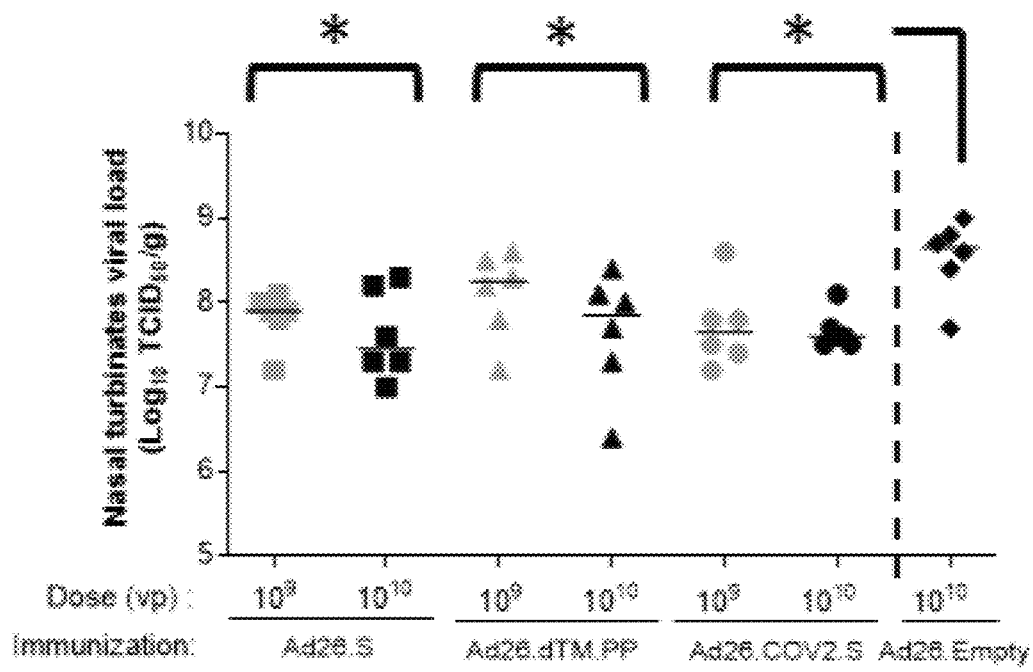
Figure 130E:
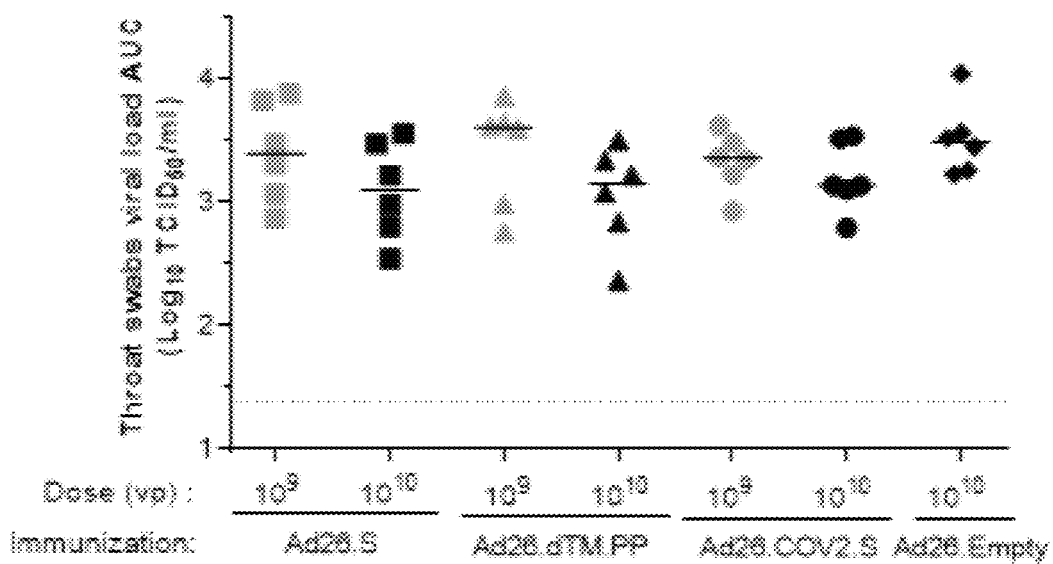
Figure 130F:
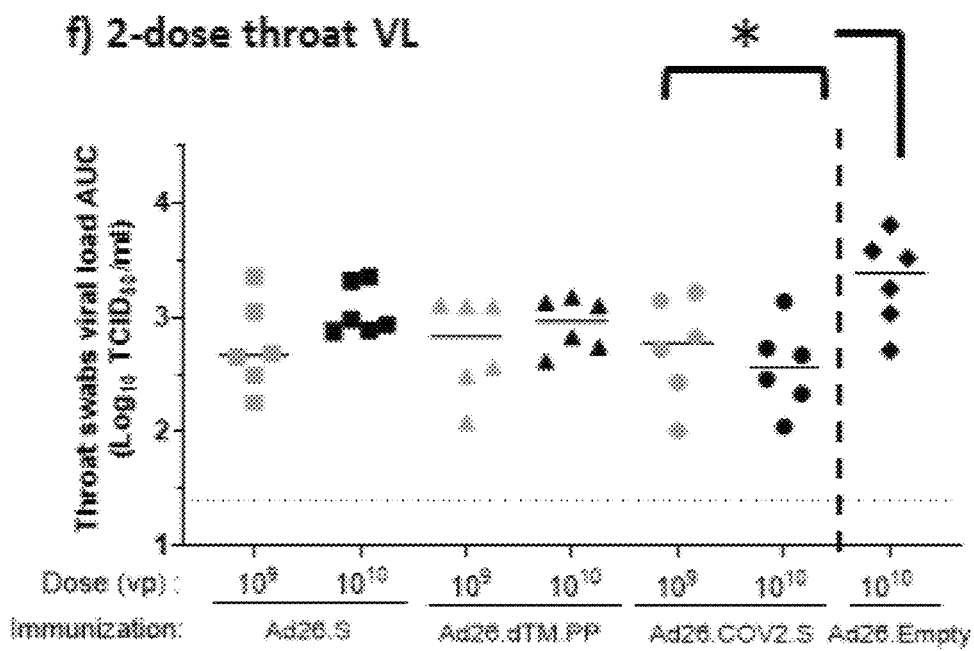
Figure 131A:
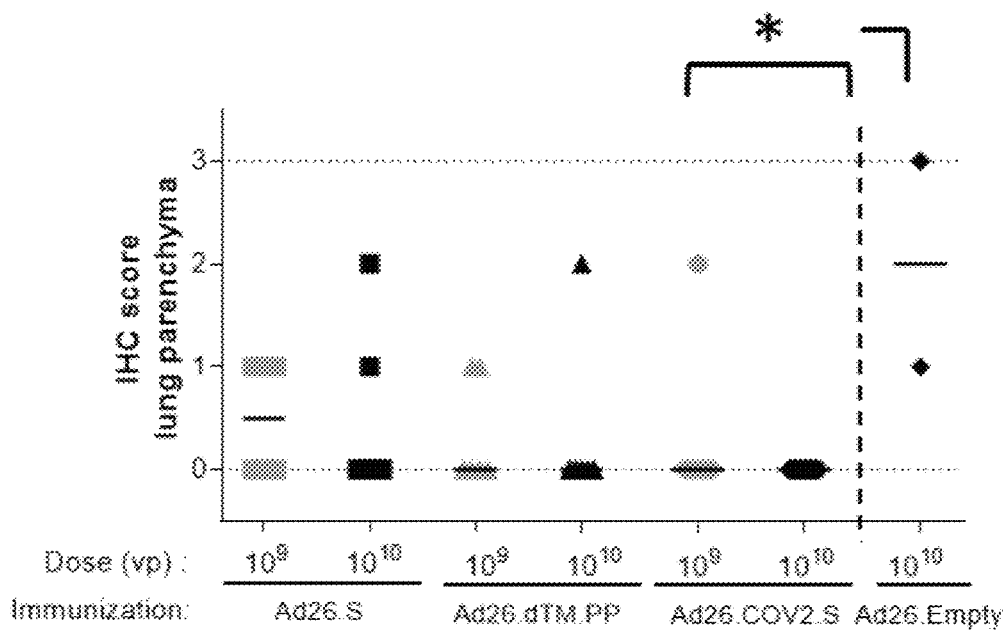
Figure 131B:
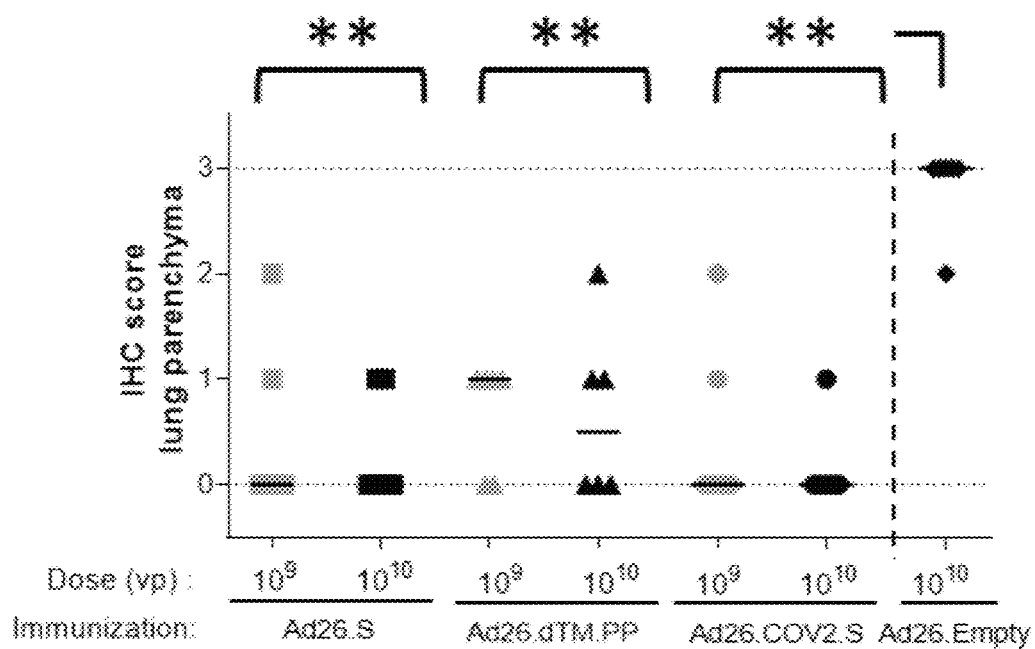
Figure 131C:
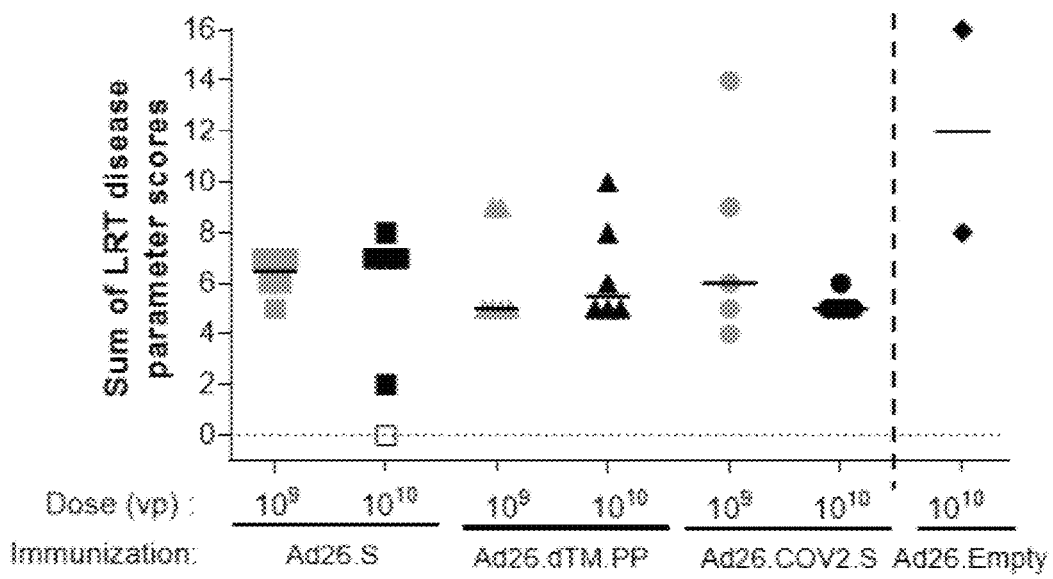
Figure 131D:
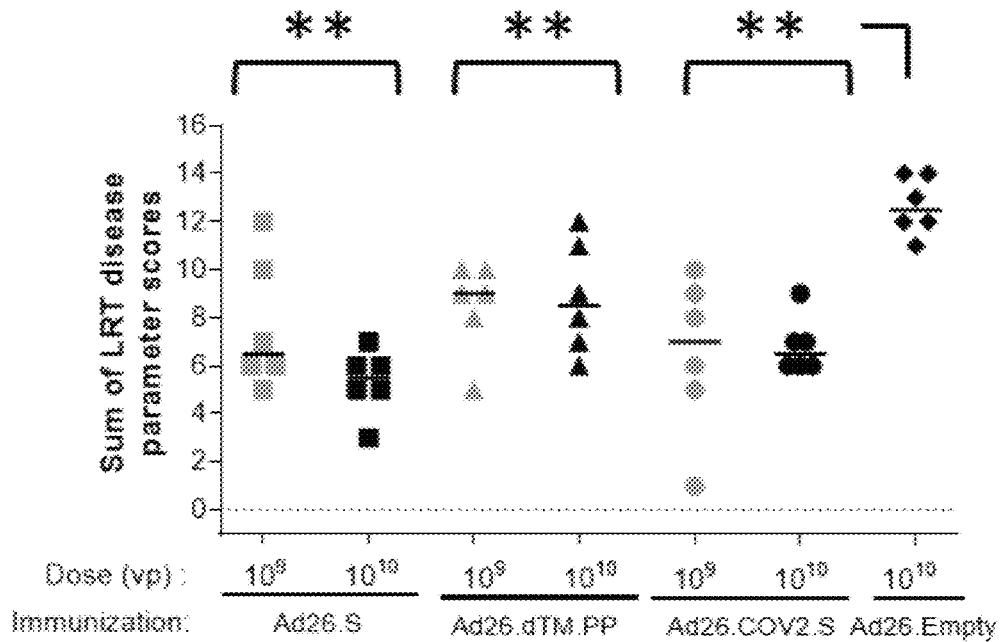
Figure 132A:
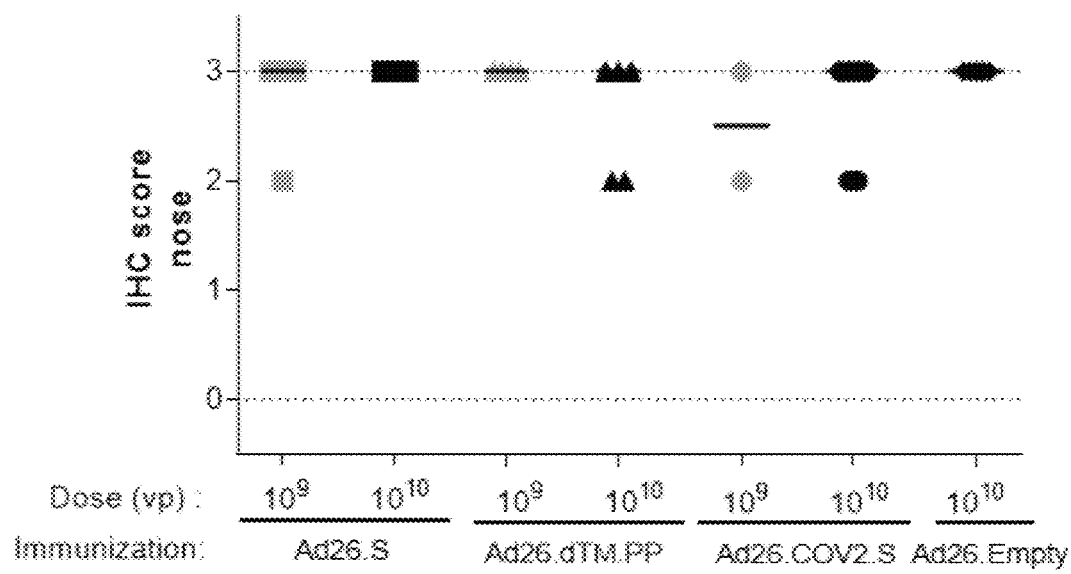
Figure 132B:
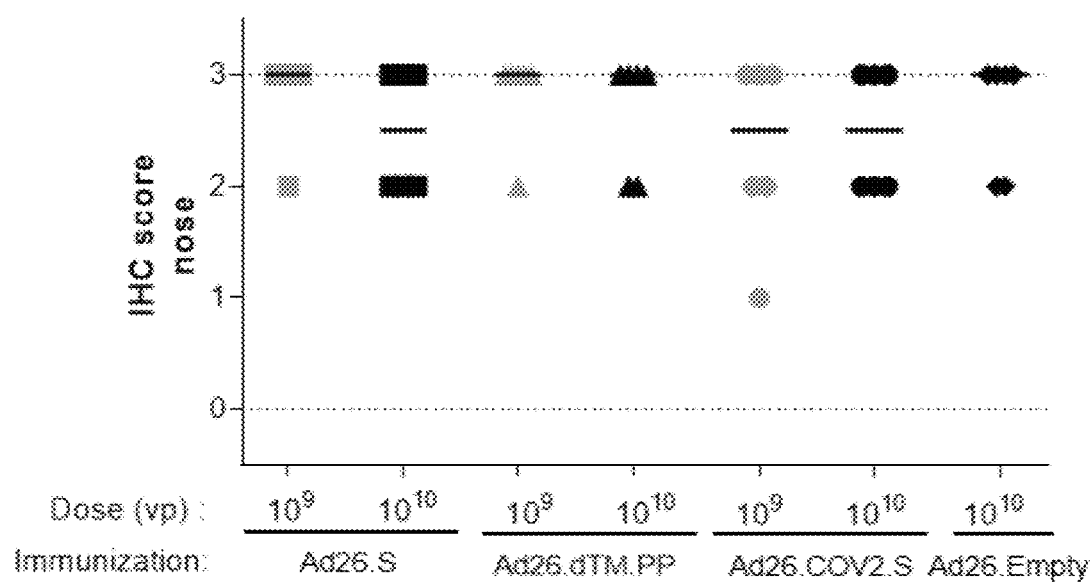
Figure 132C:
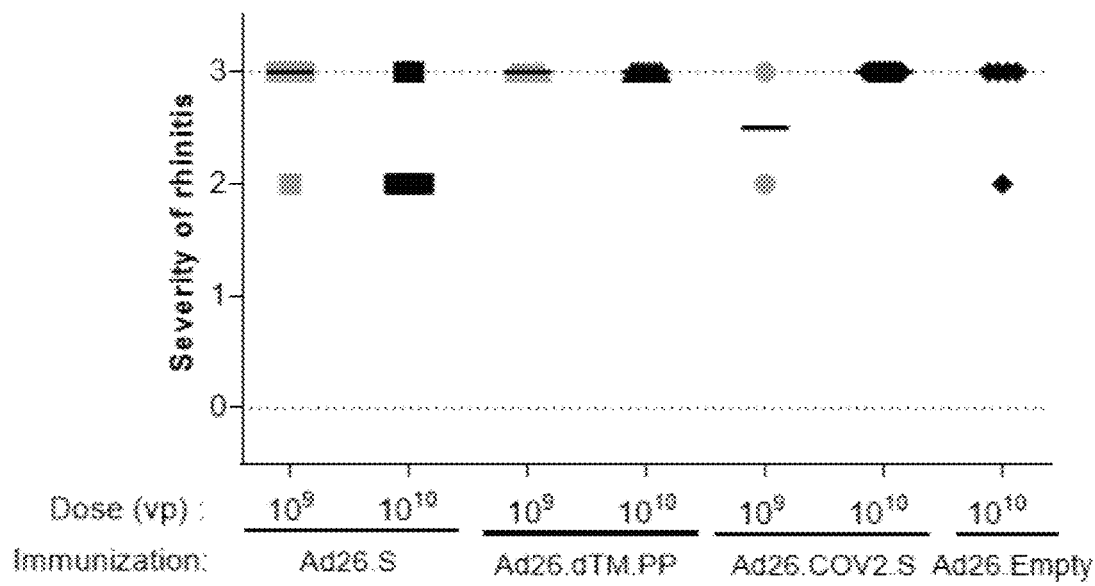
Figure 132D:
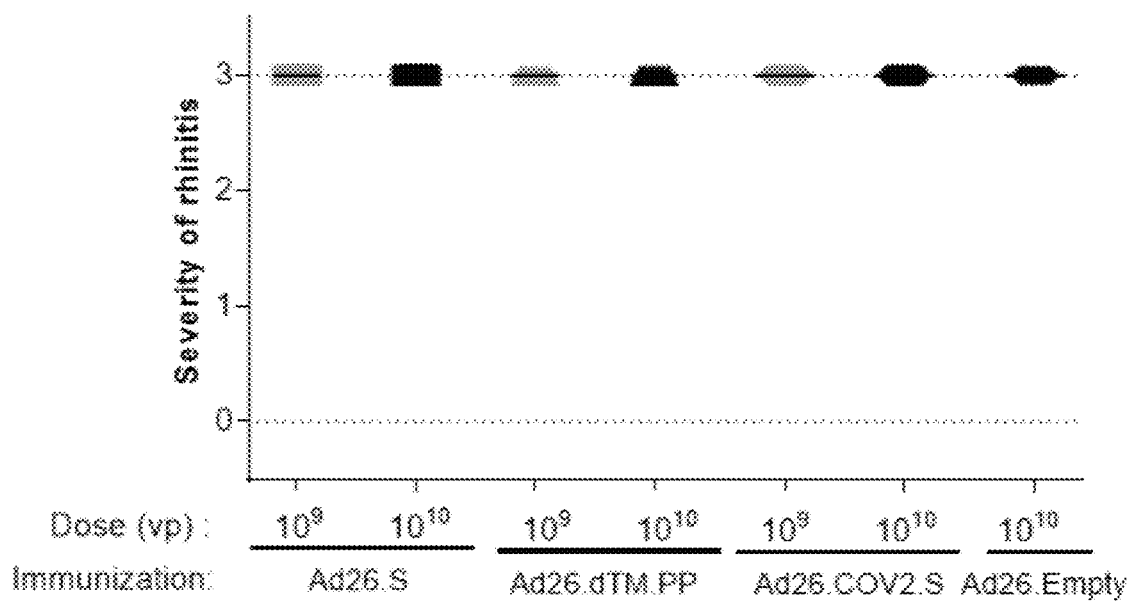

After a single vaccination and subsequent challenge, median lung viral load in all vaccine groups was significantly lower compared with the Ad26.Empty control group (median viral load $10^{7.3}$ TCID$_{50}$/g) (FIG. 130A). Virus was detected in the lungs of 11 out of 12 animals immunized with a single dose of Ad26.S (median viral load $10^9$ VP $10^{5.6}$ TCID$_{50}$/g, $10^{10}$ VP $10^5$ TCID$_{50}$/g), and in 10 out of 12 animals immunized with a single dose of A26.dTM.PP (median viral load $10^9$ VP $10^{5.3}$ TCID$_{50}$/g, $10^{10}$ VP $10^{5.7}$ TCID$^{50}$/g) and no clear effect of vaccine dose was observed. By contrast, only 3 out of 12 animals immunized with a single dose of Ad26.COV2.S had detectable virus in the lung (median titer of pooled dose levels $10^{1.2}$ TCID$_{50}$/g). Of hamsters vaccinated with a second dose of Ad26.COV2.S again 9 out of 12 animals had undetectable viral load for both vaccine dose levels, suggesting no added value of the second dose. Viral loads in the animals with breakthrough infections were also similar to the viral loads in animals with breakthough infections after one vaccination. A second dose of $10^9$ VP Ad26.S or Ad26.dTM.PP also had little impact on the lung infection rate post challenge at week 8 (5 out of 6 animals showed detectable viral load per vaccine) but a second dose of $10^{10}$ VP of these prototype vaccines was associated with lower median lung viral loads compared with a 1-dose regimen (median titer $10^2$ TCID$_{50}$/g and $10^4$ TCID$_{50}$/g, respectively), suggesting a benefit of a 2 dose regimen (FIG. 130B).

To determine the impact of the vaccines on viral load in the upper respiratory tract, nasal turbinate viral load was determined after sacrifice at 4 dpi, and throat swab viral load was determined daily after infection and was analyzed as area-under-curve (AUC) per animal up to day 4 post infection. In animals receiving a single vaccine dose, a limited but statistically significant reduction in nasal turbinate viral load after challenge was observed for Ad26.dTM.PP but not Ad26.COV2.S and Ad26.S compared with the control group. After 2 vaccine doses, all three vaccines induced a significant reduction in nasal turbinate viral load post challenge compared to the Ad26.Empty group. By contrast, throat swab viral load data show that none of the vaccines reduced viral burden in the throat after single immunization and subsequent inoculation with SARS-CoV-2 (FIGS. 130 C and E), and only animals immunized with two doses of Ad26.COV2.S had significantly reduced throat viral load compared to control(FIGS. 130 E and F). The observed protective efficacy results are further supported by immunohistochemistry (IHC) staining for SARS-CoV-2 NP in the lung and nose tissue, and by histopathology (FIGS. 131 and 132). Lung and nose IHC and histopathology scores were overall consistent with viral load data, with lower median scores in the lungs of immunized groups compared with the Ad26.Emtpy group (FIG. 131) and no reduction in the amount of viral infection and subsequent pathology in nose tissues of vaccinated animals compared with the Ad26.empty control group independent of vaccine regimen (FIG. 132).

Syrian Hamsters Immunized with Sub-Optimal Dose Levels A26.COV2.S do not Show Signs of VAERD after SARS-CoV-2 Inoculation and Breakthrough Infection.

Figure 133A:
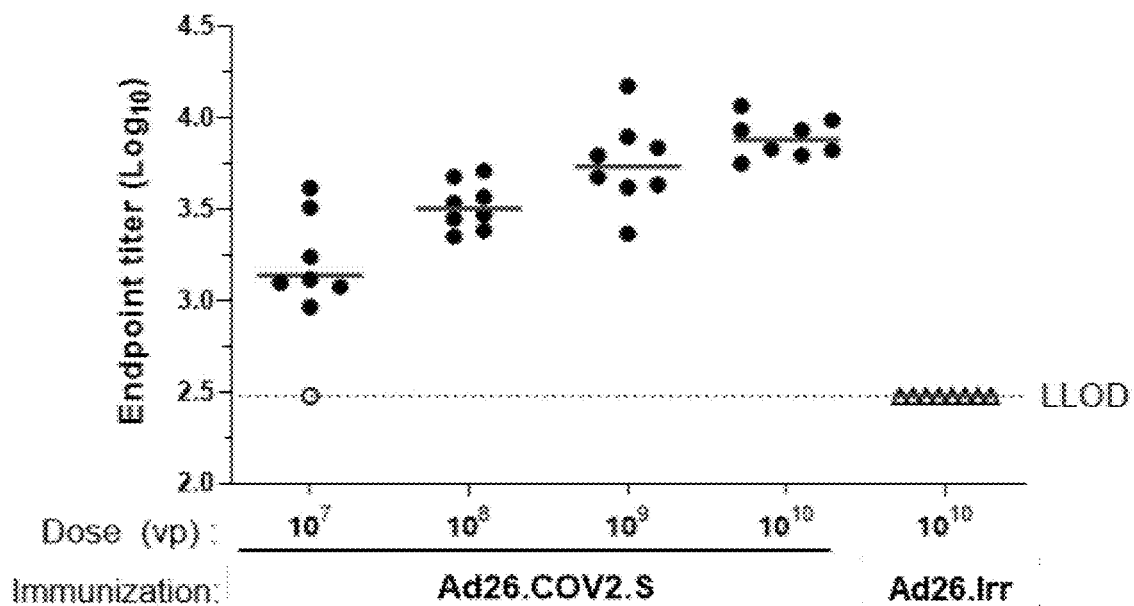
Figure 133B:
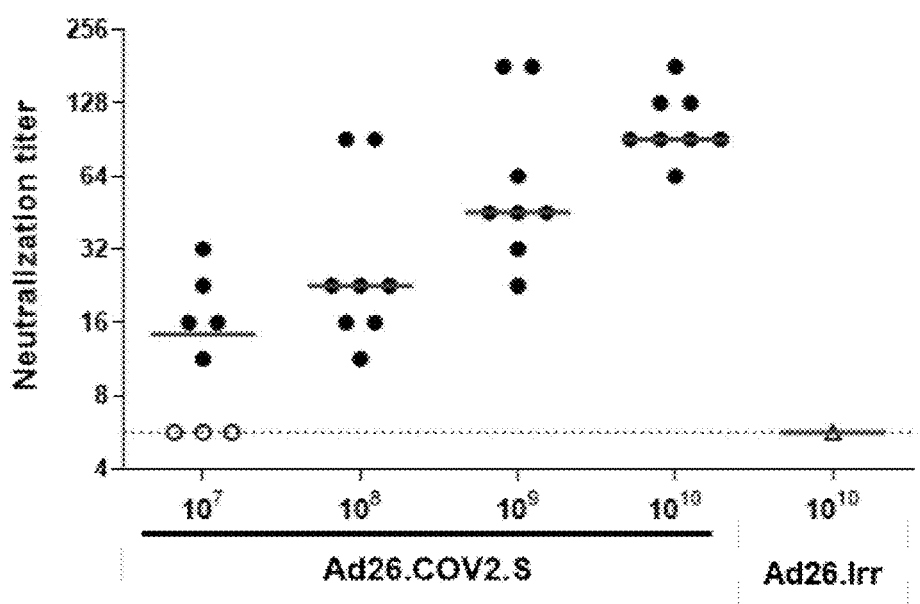
Figure 133C:
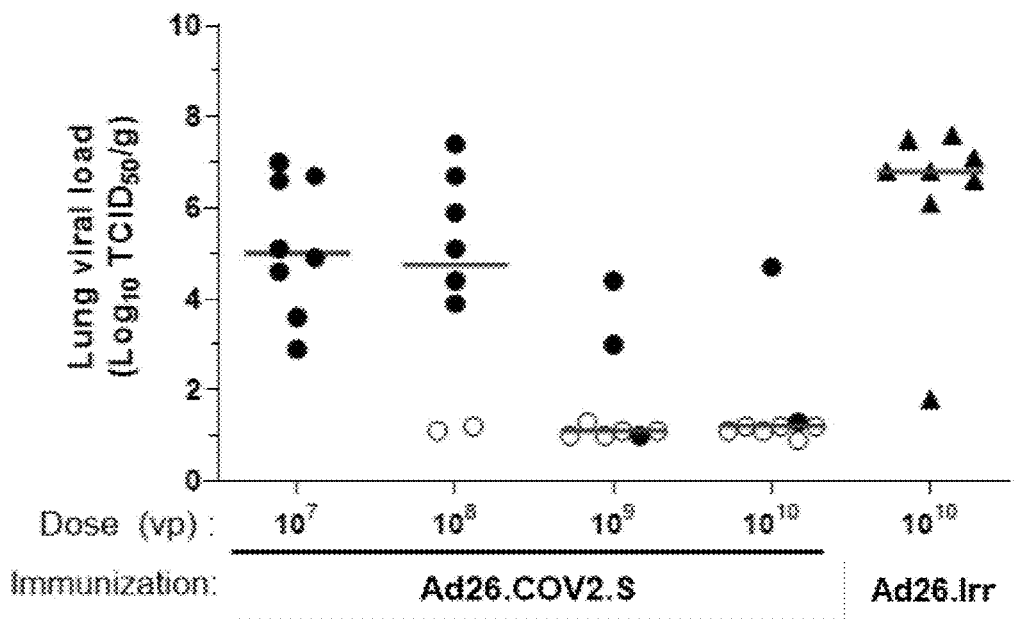
Figure 133D:
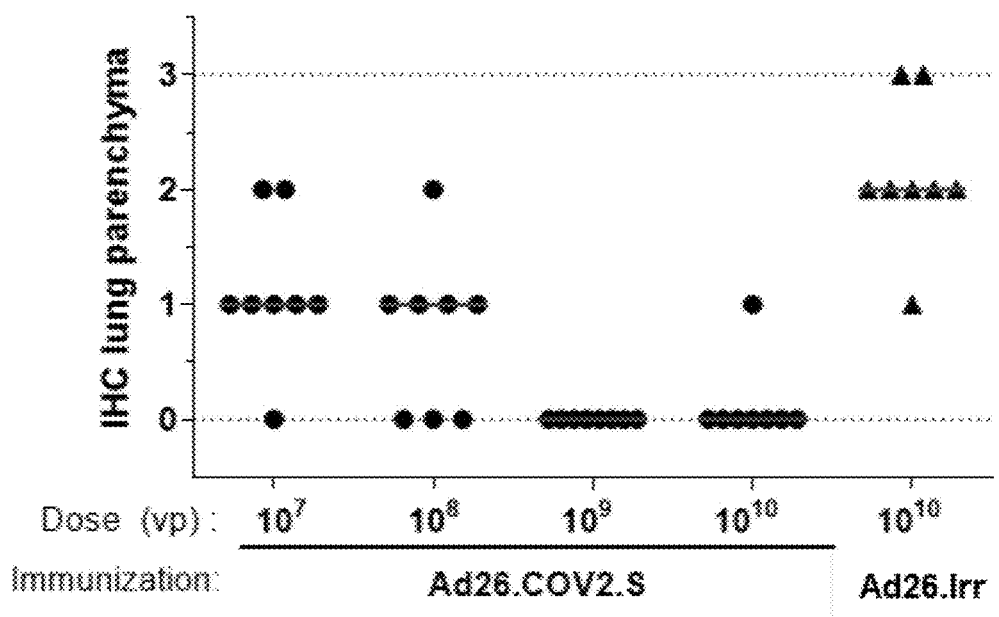

Based on the observed immunogenicity and efficacy, Ad26.COV2.S was selected for further evaluation in a dose titration study to address the theoretical risk of VAERD under conditions of suboptimal immune responses allowing breakthrough infection after SARS-CoV-2 challenge. Groups of hamsters were immunized with a single dose of Ad26.COV.S at $10^7$, $10^8$, $10^9$ or $10^{10}$ VP (4 groups; n=8/group). The control group received $10^{10}$ VP of a control vaccine encoding an irrelevant antigen (Ad26.Irr). At 4 weeks post immunization we observed a clear dose response of binding and neutralizing antibodies, both in number of responding animals and in antibody titers, with no detectable neutralizing antibody titers in 3 out of 8 animals at the lowest dose level of $10^7$ VP (FIGS. 133 and B). For the $10^9$ and $10^{10}$ VP doses, median levels of binding antibodies (median endpoint titer of $10^{3.7}$ and $10^{3.9}$, respectively) and median neutralizing antibody responses (median neutralization titers of 45 and 91, respectively) were consistent with observations in the previous study. After challenge with 102 $TCID_{50}$ SARS-CoV-2, hamsters dosed with $10^9$ and $10^{10}$ VP of Ad26.COV2.S showed similar frequencies of breakthrough lung infection as the comparable groups in the previous study (FIG. 130A), with 3 out of 8 and 2 out of 8 animals with detectable lung viral load in the dose titration study, respectively. Despite the increase in the number of animals that had breakthrough infections at lower Ad26.COV2.S dose levels (6 out of 8 animals that received $10^8$ VP and 8 out of 8 that received $10^7$ VP), the median lung viral load titers (median of $10^{4.8}$ TCID50/g at $10^8$ VP, median of $10^5$ $TCID_{50}$/g at $10^7$ VP) and IHC staining of SARS-CoV-2 NP in these groups (median scores 1) were lower than in the control group (median lung viral load $10^{8.8}$ $TCID_{50}$/g and IHC median score 2) (FIGS. 133C and D).

Congruent with lung viral load and IHC staining results, immunization with $10^8$, $10^9$ and $10^{10}$ VP significantly reduced histopathology in the lower respiratory tract compared with mock-immunized hamsters (FIG. 134A). Immunization with $10^9$ and $10^{10}$ VP resulted in absence of any signs of lower respiratory tract histopathology in 4 out of 8 and 3 out of 8 hamsters, respectively. Notably, despite detectable breakthrough lung infection in all hamsters dosed with $10^7$ VP and in most hamsters immunized with $10^8$ VP, median lower respiratory tract histopathology scores were lower when compared with the mock immunized group. The inflammation score of nasal tissue (rhinitis) showed no significant differences between vaccinated and control groups (FIG. 134B). Collectively, these data demonstrate that the presence of low levels of neutralizing antibodies elicited by sub-optimal Ad26.COV2.S vaccine does not aggravate lung disease in challenged Syrian hamsters when compared to a mock vaccine.

Binding and Neutralizing Antibodies Correlate with Protection.

To determine putative correlates of protection, binding and neutralizing antibody titers from different regimens and dose levels were pooled for Ad26.COV2.S (N=56), and compared between protected and unprotected animals (FIG. 135). Protection from SARS-CoV-2 infection was defined as a lung viral load below $10^2$ TCID/g, based on the observation that only few animals with detectable viral load fall below this margin, which was likely related to variation in the available sample quantity per animal (FIGS. 129A and B, and FIG. 133C). Protected animals dosed with Ad26.COV2.S had significantly (2.3-fold) higher median binding antibody titers than unprotected animals (p<0.001, two sample t-test) (FIG. 135A Similar results were observed for an analogous analysis of median neutralizing antibody titers, which were also significantly (4-fold) increased in animals immunized with Ad26.COV2.S with undetectable lung viral load compared with unprotected animals (p<0.001, two sample t-test) (FIG. 135B).

To gain a more quantitative understanding of the relationship between immune response levels and protection outcome, we built logistic regression models with Firth's correction (FIG. 135C). Hamsters were classified either as infected or protected from SARS-CoV-2, defined as a lung viral load of either above or below $10^2$ $TCID_{50}$/g, respectively. Both binding and neutralizing antibodies showed a robust icorrelation with protection probability. Binding antibody titers were correlated significantly with the probability of protection (p=0.0004), with endpoint titers above $10^{3.6}$ appearing to be linked with protection from lung infection. A comparable significant slope (p=0.0002) was observed with neutralizing antibody titers where titers above 32 appeared to be linked with protection outcome.

Conclusions

In a previous study (Example 21) using a prototype early SARS-CoV-2 isolate it was demonstrated that immune responses elicited by a single dose of Ad26.COV2.S can reduce viral load and protect hamsters from severe clinical disease. However, during the ongoing SARS-CoV-2 pandemic, a virus variant with a D614G substitution in the spike protein has emerged. This mutation has been associated with increased viral fitness, enhanced infectivity and has now become the dominant variant in large parts of the world, albeit it may be replaced over time by new variants that are constantly emerging. In Syrian hamsters, it was confirmed that the D614G variant was associated with higher infectious viral titers in the upper respiratory tract but not in the lungs. Here we describe the establishment of an additional hamster challenge model of mild to moderate disease using a SARS-CoV-2 strain containing the prevalent D614G substitution. We used this model to test the protective efficacy of immune responses elicited by our COVID-19 vaccine candidate Ad26.COV2.S and two Ad26-based prototype vaccines that encode different SARS-CoV-2 spike variants. Our study demonstrates that the disease progression in this hamster challenge model shows features of a moderate disease course in humans with clear histopathological lung disease which was only marginally exacerbated by inoculating with higher virus doses. Peak lung viral load was not affected by the intranasal inoculation dose level suggesting infection of the majority of primary susceptible lung cells leading to peak viremia at day 2 post inoculation. In line with our previous studies in NHPs and hamsters, Ad26.COV2.S vaccination reduced viral replication by 6 $log_{10}$ below the level observed in control animals with many animals that received higher vaccine doses showing undetectable viral replication. Ad26.COV2.S significantly outperformed the two prototype vaccines, both for immunogenicity as for protective efficacy. Earlier data in combination with the present study indicate that Ad26.COV2.S elicited immune responses give adequate protection against SARS-CoV-2 variants with and without the D614G spike mutation.

We extended previous studies by evaluation of a second homologous dose of Ad26.COV2.S and the prototype vaccines that only moderately improved binding antibody levels, while neutralizing antibody titers were substantially boosted. This contrasts observations in NHP, where a second vaccine dose significantly boosted both neutralizing and binding antibody levels. Possible explanations include limited translatability of dose levels between hamsters and NHP, differential impact of anti-Ad26 vector responses elicited by the first dose on the immunogenicity of a second homologous dose between species, and that a shorter interval between immunizations can reduce the impact of a second dose, as previously observed in NHP. In addition, the high binding antibody levels induced by a single immunization in hamsters might represent saturating levels while neutralizing antibodies could still increase after a second dose, possibly reflecting extended affinity maturation. The advantage of a second homologous vaccine dose for humoral SARS-CoV-2 S-specific immune responses was also observed in rabbits immunized with the same Ad26-based vaccines and confirming our clinical data (Sadoff, le Gars, NEJM in press). Whether a 2-dose regimen is also preferred for improved vaccine efficacy remains to be seen.

Interestingly, a second dose of Ad26.S or Ad26.dTM.PP increased protection against lung viral load after challenge compared with the low protection achieved by a single vaccination of hamsters with these prototype vaccines. In contrast, a second dose of Ad26.COV2.S did not further increase the already high level of efficacy established by a single dose. This is supported by our correlate analysis where the probability of protection increases with a higher antibody titer, and if a certain antibody titer is reached protection probability increases only moderately. This inverse correlation of antibodies and lung protection confirms our previous study in NHPs in this SARS-CoV-2-D614G Syrian hamster model and was irrespective of vaccine, dose level or regimen. The correlation of S specific humoral immunity with protection in humans needs further investigation once efficacy data is available and may be inform next generation COVID-19 vaccine design and other vaccines in development.

In addition to protection from COVID-19, vaccine-elicited immunity ideally also protects against asymptomatic infection as well as against transmission of virus by reduction of viral load in the upper respiratory tract. As observed in other SARS-CoV-2 animal models and for other respiratory virus infections, the upper respiratory tract appears to be more difficult to protect from viral infection and shedding with parental immunization In this hamster challenge model we observed high replication-competent virus levels in the nasal turbinates despite the low virus inoculum dose used, which is in line with the observation that the spike D614G substitution increases SARS-CoV-2 infectivity in the upper respiratory tract of challenged hamsters. As the challenge inoculum dose is low it is unlikely that the viral load in nasal turbinates detected 4 days later are derived from the original inoculum. Viral load reduction in nose tissue required two vaccine doses, irrespective of the vaccine used. Two doses of Ad26.COV2.S was the only regimen that also decreased viral titers in throat swabs. Reduction of viremia in the upper respiratory tract was limited compared to the lower respiratory tract which is in contrast to our NHP studies where we observed almost complete reduction of nasal viral load. This may be explained by a difference in the susceptibility of the nasal epithelium for viral replication, or the potentially different composition of immune cells present in the respiratory tract between hamsters and primates and different induction of local upper respiratory tract immunity by Ad26. Whether Ad26.COV2.S elicited immunity can protect against asymptomatic infection and SARS-CoV-2 transmission remains to be determined in future animal studies and from human data.

Previous studies with candidate coronavirus vaccines against SARS-CoV and MERS indicated that disease can be exacerbated by certain vaccine-elicited immune responses. However, neither VAERD nor antibody-mediated disease enhancement have been reported following vaccination with SARS-CoV-2 vaccine candidates in pre-clinical animal models or in ongoing clinical studies including efficacy reports of phase 3 studies of mRNA and other adenoviral vector based or whole inactivated vaccines. Nevertheless, vaccine efficacy in clinical studies so far was high and the theoretical potential for VAERD requires further investigation especially in the setting of suboptimal immunity induced. We therefore assessed the potential for Ad26.COV2.S to predispose for VAERD in a setting where levels of vaccine-induced antibodies were not sufficient to prevent viral replication in the lung as animals received only a low Ad26.COV2.S dose. Importantly even in the setting of insufficient immunity not preventing lung viral replication, the lower respiratory tract histopathology scores of immunized animals showed no signs of VAERD when compared to the control group. Conversely, most vaccinated animals with breakthrough infection still showed reduced histopathology compared with control animals. These results imply that the theoretical risk that Ad26.COV2.S would predispose for VAERD is minimal.

Our study confirms that the Ad26.COV2.S vaccine candidate is highly immunogenic and can protect hamsters against challenge with a SARS-CoV-2 virus 614G variant. The excellent potency of Ad26.COV2.S and the absence of data that it would predispose for VAERD, supports its continuous evaluation in the ongoing Phase 3 clinical trials in a single and a two dose regimen.

Example 30: Immunogenicity of the Ad26.COV2.S COVID-19 Vaccine in Humans

As part of the randomized, double-blinded, placebo-controlled phase 1 clinical trial of Ad26.COV2.S (see also Examples 23, 24 and 27), 25 participants were enrolled at a single clinical site to assess the immunogenicity of this vaccine in depth. In this Example, the kinetics and magnitude of the humoral and cellular immune responses elicited by single-shot and two-shot regimens of Ad26.COV2.S are reported.

Materials and Methods
Study Design.

This study was performed as part (cohort 1b) of a multicenter, randomized, double-blind, placebo-controlled Phase 1/2a trial to evaluate safety, reactogenicity and immunogenicity of Ad26.COV2.S at $5 \times 10^{10}$ or $1 \times 10^{11}$ vp administered intramuscularly (IM) as single-shot or two-shot vaccine schedules, 56 days apart, in healthy adults. Cohort 1 a enrolled adults 18-55 years of age (n=375) and focused on collecting primary safety and immunogenicity endpoints. Cohort 1b (reported here) also enrolled adults 18-55 years of age (n=25) but included two additional visits and increased sampling of serum, plasma and peripheral blood mononuclear cells to allow for investigation of exploratory endpoints. Cohort 3 (n=375) enrolled participants who were >65 years of age and tested the same regimens as evaluated in Cohort 1. Participants in cohort 1b were enrolled at a single site at Beth Israel Deaconess Medical Center in Boston, Mass. The protocol was approved by the BIDMC Institutional Review Board and was registered at ClinicalTrials-.gov (NCT04436276).

Study Participants.

Eligible participants were 18-55 years old (inclusive) and negative for SARS-CoV-2 infection by screening nasopharyngeal PCR and serum immunoglobulin testing. Eligible participants also had a body mass index (BMI) ≤30.0 kg/m$^2$, and were healthy, in the investigator's clinical judgment, as confirmed by medical history, physical examination, clinical laboratory assessments, and vital signs performed at screening, and did not have comorbidities related to an increased risk of severe COVID-19. Participants who were of childbearing potential were required to use highly effective contraception and could not be pregnant or breastfeeding. Participants were excluded if they were currently working in an occupation with a high risk of exposure to SARS-CoV-2 or considered at the investigator's discretion to be at increased risk to acquire COVID-19 for any other reason. All participants gave written informed consent and successfully completed an assessment of understanding before the initiation of study procedures. Full eligibility criteria are described in the study protocol.

Randomization and Masking.

Randomization was done by an Interactive Web Response System (IWRS) using randomly permuted blocks. The sponsor, clinical staff, investigators, participants, and laboratory personnel were blinded to assignment. Sponsor and statisticians were group-unblinded for the interim analysis when all participants completed the day 29 visit or discontinued earlier. The pharmacist with primary responsibility for study product preparation and dispensing was not blinded to group assignment. To preserve blinding, he/she placed an overlay on the syringes.

Investigational Product

Ad26.COV2.S is a recombinant, replication-incompetent Ad26 vector encoding the full length and stabilized SARS-CoV-2 S protein derived from the first clinical isolate of the Wuhan strain (Wuhan, 2019, whole genome sequence NC_045512), as described herein. Ad26.COV2.S was supplied at a concentration of $1 \times 10^{11}$ vp/mL as a suspension in single-use vials, with an extractable volume of 0.5 mL. Formulation buffer was supplied as 15 mM citrate, 5% (w/w) hydroxypropyl-β-cyclodextrin, 0.4% (w/w) ethanol, 0.03% (w/w) polysorbate 80, 75 mM NaCl, pH 6.2 and placebo is 0.9% NaCl. For blinding purposes, the same volume (1 mL) was administered to all participants. Study vaccine was administered by IM injection into the deltoid muscle, preferably of the non-dominant arm. Placebo consisted of 1 mL of 0.9% NaCl solution.

Safety Assessments.

Solicited AEs, collected through a diary, were recorded for each vaccination from the time of vaccination until 7 days post-vaccination. All other unsolicited AEs and special reporting situations, whether serious or non-serious, were reported for each vaccination from the time of vaccination until 28 days post-vaccination (data post-second vaccine is not reported here). Unsolicited AEs with the onset date outside the timeframe defined above (>28 days after previous study vaccination), which are ongoing on the day of the subsequent vaccination, will be recorded as such. All SAEs and AEs leading to discontinuation from the study/vaccination (regardless of the causal relationship) are reported for all participants from the moment of first vaccination until completion of the participant's last study-related procedure, which may include contact for safety follow-up. All AEs will be followed until resolution or until clinically stable. An internal Data Review Committee (DRC), consisting of members that are not directly involved in the study conduct, data management, or statistical analysis, was established and will monitor data to ensure the continuing safety of the participants enrolled in this study.

Sample Size and Statistical Analysis.

No formal statistical hypothesis for safety or immunogenicity was tested. The number of participants was chosen for this study to provide a preliminary safety and immunogenicity assessment. Placebo recipients were included for blinding and safety purposes and to provide additional control specimens for immunogenicity assays. The full analysis set (FAS) includes all participants with at least one vaccine administration documented. The per protocol immunogenicity (PPI) population includes all randomized and vaccinated participants for whom immunogenicity data are available excluding participants with major protocol deviations expecting to impact the immunogenicity outcomes. In addition, samples obtained after missed vaccinations or participants with natural infection occurring after screening (if applicable) were excluded from the analysis set. No formal statistical testing of safety data is planned. Safety data was analyzed descriptively by vaccine group. No formal hypothesis on immunogenicity was tested. Descriptive statistics were calculated for continuous immunologic parameters at all available time points. Immunogenicity analyses were performed on the PPI population. Analysis of immunologic data was performed using GraphPad Prism 8.4.2 (GraphPad Software). Comparison of data between groups was performed using two-sided Mann-Whitney tests. Correlations were assessed by two-sided Spearman rank-correlation tests. P-values of less than 0.05 were considered significant.

Enzyme-Linked Immunosorbent Assay (ELISA).

S- and RBD-specific binding antibodies were assessed by ELISA essentially as described (Chandrashekar et al., Science 369, 812-817 (2020); Yu et al., Science 369, 806-811 (2020)). Briefly, 96-well plates were coated with 1 μg/ml SARS-CoV-2 S or 2 μg/ml SARS-CoV-2 RBD protein in 1×DPBS and incubated at 4° C. overnight. After incubation, plates were washed once with wash buffer (0.05% Tween 20 in 1×DPBS) and blocked with 350 μL Casein block/well for 2-3 h at room temperature. After incubation, block solution was discarded and plates were blotted dry. Serial dilutions of heat-inactivated serum diluted in casein block were added to wells and plates were incubated for 1 h at room temperature, prior to three further washes and a 1 h incubation with a 1:4000 dilution of anti-human IgG HRP (Invitrogen) at room temperature in the dark. Plates were then washed three times, and 100 μL of SeraCare KPL TMB SureBlue Start solution was added to each well; plate development was halted by the addition of 100 μL SeraCare KPL TMB Stop solution per well. The absorbance at 450 nm, with a reference at 650 nm, was recorded using a VersaMax microplate reader. For each sample, ELISA endpoint titer was calculated in Graphpad Prism software, using a four-parameter logistic curve fit to calculate the reciprocal serum dilution that yields a corrected absorbance value (450 nm-650 nm) of 0.2. $\text{Log}_{10}$) endpoint titers are reported. The ELISA assay was developed and qualified for human serum at the Center for Virology and Vaccine Research at Beth Israel Deaconess Medical Center.

Pseudovirus Neutralization Assay (psVNA).

The SARS-CoV-2 pseudoviruses expressing a luciferase reporter gene were generated in an approach similar to as described previously (Chandrashekar et al., Science 369, 812-817 (2020); Yu et al., Science 369, 806-811 (2020)). Briefly, the packaging construct psPAX2 (AIDS Resource and Reagent Program), luciferase reporter plasmid pLenti-CMV Puro-Luc (Addgene), and spike protein expressing pcDNA3.1-SARS-CoV-2 SΔCT were co-transfected into HEK293T cells with lipofactamine 2,000 (ThermoFisher Scientific). The supernatants containing the pseudotype viruses were collected 48 h post-transfection; pseudotype viruses were purified by filtration with 0.45 μm filter. To determine the neutralization activity of the antisera from vaccinated animals, HEK293T-hACE2 cells were seeded in 96-well tissue culture plates at a density of $1.75 \times 10^4$ cells/well overnight. Three-fold serial dilutions of heat inactivated serum samples were prepared and mixed with 50 μL of pseudovirus. The mixture was incubated at 37° C. for 1 h before adding to HEK293T-hACE2 cells. After 48 h, cells were lysed in Steady-Glo Luciferase Assay (Promega) according to the manufacturer's instructions. SARS-CoV-2 neutralization titers were defined as the sample dilution at which a 50% reduction in RLU was observed relative to the average of the virus control wells. The psVNA assay was developed and qualified for human serum at the Center for Virology and Vaccine Research at Beth Israel Deaconess Medical Center.

Ad26 Neutralization Assay.

A549 human lung carcinoma cells were seeded a day prior to infection at a density of $1 \times 10^4$ cells per well in 96-well plates. E1/E3-deleted, replication-incompetent rAd26.Luc reporter virus was mixed with 3-fold serial dilutions of heat-inactivated human serum and then was applied to A549 cells at a multiplicity of infection (M01) of 500. 24 hours post infection, luciferase activity in the cells was measured using the Steady-Glo Luciferase Reagent System (Promega, Madison, Wis.). Neutralization titers were defined as the maximum serum dilution that neutralized 90% of luciferase activity. The Ad26 neutralization assay was developed for human serum at the Center for Virology and Vaccine Research at Beth Israel Deaconess Medical Center.

Electrochemiluminescence Assay (ECLA).

ECLA plates (MesoScale Discovery SARS-CoV-2 IgG Panel 2; K15369U-2) were designed and produced with 9 antigen spots in each well. The antigens included were SARS-CoV-2 S, SARS-CoV-1 S, hCoV-229E S, hCoV-NL63 S, hCoV-OC43 S, and hCoV-HKU1 S. The plates were blocked with 50 uL of Blocker A solution for at least 30 m at room temperature shaking at 700 rpm with a digital microplate shaker. During blocking the serum was diluted 1:5,000 in Diluent 100. The plates were then washed 3 times with 150 μL of the MSD kit Wash Buffer, blotted dry, and 50 μL of the diluted samples were added in duplicate to the plates and set to shake at 700 rpm at room temperature for at least 2 h. The plates were again washed 3 times and 50 μL of SULFO-Tagged anti-Human IgG detection antibody diluted to 1× in Diluent 100 was added to each well and incubated shaking at 700 rpm at room temperature for at least 1 h. Plates were then washed 3 times and 150 μL of MSD GOLD Read Buffer B was added to each well and the plates were read immediately after on a MESO QuickPlex SQ 120 machine. MSD titers for each sample was reported as Relative Light Units (RLU) which were calculated as Sample RLU minus Blank RLU for each spot for each sample. The limit of detection was defined as 1000 RLU for each assay.

IFN-γ Enzyme-Linked Immunospot (ELISPOT) Assay.

ELISPOT plates were coated with mouse anti-human IFN-γ monoclonal antibody from MabTech at a concentration of 1 pg/well overnight at 4° C. Plates were washed with DPBS, and blocked with R10 media (RPMI with 10% heat inactivated FBS with 1% of 100× penicillin-streptomycin, 1M HEPES, 100 mM Sodium pyruvate, 200 mM L-glutamine, and 0.1% of 55 mM 2-Mercaptoethanol) for 2-4 h at 37° C. The Spike 1 and Spike 2 peptide pools contain 15 amino acid peptides overlapping by 11 amino acids that span the protein sequence and reflect the N- and C-terminal halves of the protein, respectively. Spike 1 and Spike 2 peptide pools were prepared at a concentration of 2 pg/well, and 200,000 cells/well were added to the plate. The peptides and cells were incubated for 15-20 h at 37° C. All steps following this incubation were performed at room temperature. The plates were washed with ELISPOT wash buffer and incubated for 2-4 h with Biotinylated mouse anti-human IFN-γ monoclonal antibody from MabTech (1 μg/mL). The plates are washed a second time and incubated for 2-3 h with Alkaline phosphatase-conjugated anti-biotin monoclonal antibody from Vector Laboratories (1.33 μg/mL). The final wash was followed by the addition of Nitor-blue Tetrazolium Chloride/5-bromo-4-chloro 3'indolyphosphate p-tolu-dine salt (NBT/BCIP chromagen) substrate solution for 7 min. The chromagen was discarded and the plates were washed with water and dried in a dim place for 24 h. Plates were scanned and counted on a Cellular Technologies Limited Immunospot Analyzer. The IFN-γ ELISPOT assay was developed and qualified for human serum at the Center for Virology and Vaccine Research at Beth Israel Deaconess Medical Center.

IL-4 ELISPOT Assay.

ELISPOT plates were coated with IL4-I monoclonal antibody from MabTech at 1.5 μg/well overnight at 4° C. Plates were washed with 1× PBS and blocked with R10 media (RPMI with 10% heat inactivated FBS with 1% of 100× penicillin-streptomycin, 1M HEPES, 100 mM Sodium pyruvate, 200 mM L-glutamine, and 0.1% of 55 mM 2-Mercaptoethanol) for 30 min-4h. Spike 1 and Spike 2 peptide pools were prepared at a concentration of 2 pg/well, and 200,000 cells/well were added. The peptides and cells were incubated for 18-48 h at 37° C. All steps following this incubation were performed at room temperature. The plates were washed with 1× PBS and incubated for 2 h with Biotinylated monoclonal antibody IL4-II from MabTech (1 pg/well). The plates are washed a second time and incubated for 1 h with Streptavidin-Alkaline Phosphatase from MabTech (1:1000). The final wash was followed by the addition of Nitor-blue Tetrazolium Chloride/5-bromo-4-chloro 3'indolyl phosphate p-toludine salt (NBT/BCIP chromagen) substrate solution for 12-15 min. The chromagen was discarded and the plates were washed with water and dried in a dim place for 24 h. Plates were scanned and counted on a Cellular Technologies Limited Immunospot Analyzer. The IL-4 ELISPOT assay was developed and qualified for human serum at the Center for Virology and Vaccine Research at Beth Israel Deaconess Medical Center.

Intracellular Cytokine Staining (ICS) Assay.

$10^6$ PBMCs/well were re-suspended in 100 μL of R10 media supplemented with anti-CD28, CD49d monoclonal antibody (1 μg/mL). Each sample was assessed with mock (100 μL of R10 plus 0.5% DMSO; background control), peptide pools (2 μg/mL), or 10 μg/mL phorbol myristate acetate (PMA) and 1 µg/mL ionomycin (Sigma-Aldrich) (100 µL; positive control) and incubated at 37° C. for 1 h. After incubation, 0.25 µL of GolgiStop and 0.25 µL of GolgiPlug in 50 µL of R10 was added to each well and incubated at 37° C. for 8 h and then held at 4° C. overnight. The next day, the cells were washed twice with DPBS, stained with Aqua live/dead dye (Life Technologies) for 10 mins and then stained with predetermined titers of mAbs against CD279 (clone EH12.1, BB700, BD Pharmingen), CD4 (clone L200, BV711, BD), CD27 (clone M-T271, BUV563, BD Pharmingen), CD8 (clone SK1, BUV805, BD), CD45RA (clone 5H9, APC H7, BD) for 30 min. Cells were then washed twice with 2% FBS/DPBS buffer and incubated for 15 min with 200 µL of BD CytoFix/CytoPerm Fixation/Permeabilization solution. Cells were washed twice with 1× Perm Wash buffer (BD Perm/Wash™ Buffer 10× in the CytoFix/CytoPerm Fixation/Permeabilization kit diluted with MilliQ water and passed through 0.22 µm filter) and stained with intracellularly with mAbs against Ki67 (clone B56, Alexa488, BD), IL21 (clone 3A3-N2.1, PE, BD Pharmingen), CD69 (clone TP1.55.3, ECD, Beckman Coulter), MO (clone JES3-9D7, PE CY7, Biolegend), IL13 (clone JES10-5A2, BV421, BD Pharmingen), IL4 (clone MP4-25D2. BV605, Biolegend), TNF-α (clone Mab11, BV650, BD), IL17 (clone N49-653, BV750, BD), IFN-γ (clone B27; BUV395, BD), IL2 (clone MQ1-17H12, BUV737, BD Pharmingen), IL6 (clone MQ2-13A5, APC, BD), CD3 (clone SP34.2, Alexa 700, BD), for 30 min. Cells were washed twice with 1× Perm Wash buffer and fixed with 250 µL of freshly prepared 1.5% formaldehyde. Fixed cells were transferred to 96-well round bottom plate and analyzed by BD FACSymphony system. The ICS assay was developed for human serum at the Center for Virology and Vaccine Research at Beth Israel Deaconess Medical Center.

Results

Study Design

Twenty-eight participants were screened between Jul. 27, 2020 and Aug. 7, 2020 at Beth Israel Deaconess Medical Center in Boston, Mass. Two participants were ineligible due to a positive diagnostic test for SARS-CoV-2 at screening, and one was ineligible due to body mass index >30 kg/m². Twenty-five participants were randomized and received at least one dose of vaccine or placebo. Participants were randomly allocated to one of five experimental groups (N=5/group): (i) $5 \times 10^{10}$ vp Ad26.COV2.S (low dose; LD) on day 1 and day 57 (LD/LD); (ii) LD on day 1 and placebo on day 57 as a single-shot vaccine (LD/PL); (iii) $1 \times 10^{11}$ vp Ad26.COV2.S (high dose; HD) on day 1 and day 57 (HD/HD); (iv) HD on day 1 and placebo on day 57 as a single-shot vaccine (HD/PL); or (v) placebo on day 1 and day 57 (PUPL). Safety data from these 25 participants have been reported separately (Sadoff et al., New Engl. J. Med., in press).

Kinetics and Magnitude of Binding and Neutralizing Antibody Responses

By day 8 following immunization, binding antibodies were observed in 65% (13 of 20) of vaccine recipients against full-length spike (S) (FIG. 136A; P=0.0194, two-sided Mann-Whitney test) and in 90% (18 of 20) of vaccine recipients against the receptor binding domain (RBD) (FIG. 136B; P=0.0033, two-sided Mann-Whitney test) by ELISA. A trend was also observed on day 8 for virus neutralizing antibodies in 25% (5 of 20) of vaccine recipients (FIG. 136C) by a luciferase-based pseudovirus neutralizing antibody (psVNA) assay (5-7). These data demonstrate rapid induction of binding and neutralizing antibody responses following Ad26.COV2.S vaccination in humans.

By day 15, S-specific and RBD-specific binding antibodies were observed in 100% (20 of 20) vaccine recipients (FIG. 137A), and neutralizing antibodies were observed in 85% (17 of 20) vaccine recipients (FIG. 137B). Binding and neutralizing antibodies continued to increase on days 29, 57, and 71. By days 57 and 71, 100% (20 of 20) vaccine recipients showed neutralizing antibodies as well as S- and RBD-specific binding antibodies. On day 71, the geometric mean titers (GMTs) of S-specific binding antibodies were 2432, 3249, 5729, 2852, and 20, the GMTs of RBD-specific binding antibodies were 1018, 2023, 3666, 2372, and 21, and the GMTs of neutralizing antibodies were 242, 375, 449, 387, and 13 in the LD/LD, LD/PL, HD/HD, HD/PL, and PUPL groups, respectively (FIG. 137A, B). Taken together, these data demonstrate the rapid kinetics and robust magnitude of binding and neutralizing antibody responses following both single-shot and two-shot regimens of Ad26.COV2.S. In the single-shot groups, the persistence and increase of antibody responses through day 71 suggest durability of these responses.

The second immunization on day 57 increased binding antibody titers by an average of 2.56 fold (range 1.58-3.04) and neutralizing antibody titers by an average of 4.62 fold (range 3.56-5.68) in the LD/LD and HD/HD groups on day 71, similar to previous results (see Example 27). However, the overall GMTs in the two-shot vaccine groups were comparable to the GMTs in the single-shot vaccine groups on day 71, potentially reflecting the small numbers of participants in each group and the fact that there were two low responders in the LD/LD and HD/HD groups prior to the boost. A trend towards higher binding and neutralizing antibody responses was observed in the HD/HD group compared with the LD/LD group. The immunologic response to the boost was also manifested by an increase in Ad26 vector-specific neutralizing antibodies in the LD/LD and HD/HD groups on day 71 (FIG. 127B).

S-specific and RBD-specific binding antibody titers on day 29 strongly correlated with each other (P<0.0001, R=0.9838, two-sided Spearman rank-correlation test; FIG. 138), and both correlated with neutralizing antibody titers on day 29 (P<0.0001, R=0.8809 and P<0.0001, R=0.8604, respectively, two-sided Spearman rank-correlation tests; FIG. 138). These data suggest that vaccine-elicited antibodies generally bound both S and RBD and exhibited robust virus neutralization capacity.

To evaluate the specificity of the antibody responses to SARS-CoV-2, we utilized an electrochemiluminescence assay (ECLA; Meso Scale Discovery SARS-CoV-2 IgG Panel 2; K15369U-2). We assessed reactivity against full-length S proteins from SARS-CoV-2, SARS-CoV-1, CoV-229E, CoV-HKU1, CoV-NL63, and CoV-OC43. Ad26.COV2.S vaccination induced SARS-CoV-2 S-specific antibodies by ECLA (FIG. 139A) that were comparable to ELISA (FIG. 137A). Cross-reactive responses were also observed to the S protein from SARS-CoV-1 at approximately 10-fold lower magnitude than SARS-CoV-2 (FIG. 139A). High background levels of antibodies were observed at baseline for the S proteins from the common cold coronaviruses CoV-229E, CoV-HKU1, CoV-NL63, and CoV-OC43, with no clear increase in these responses following vaccination (FIG. 139B). These data suggest that Ad26.CoV.S elicited low levels of cross-reactive antibodies against SARS-CoV-1 but minimal to no antibodies against the more distantly related common cold CoVs.

Cellular Immune Responses

We assessed S-specific cellular immune responses by IFN-γ and IL-4 ELISPOT assays in peripheral blood mononuclear cells (PBMCs) of all participants, as well as multi-parameter intracellular cytokine staining (ICS) assays in a subset of participants for which there were sufficient PBMCs. IFN-γ ELISPOT responses were observed in 65% (13 of 20) of vaccine recipients by day 15 and in 84% (16 of 19) of vaccine recipients by day 71, with no clear differences in cellular immune responses among groups (FIG. 140A). No IL-4 responses were observed, indicating a strongly TH1-biased cellular immune response. Multiparameter ICS assays confirmed the induction of central memory CD27+CD45RA− CD4+ and CD8+ T cell responses in all but one vaccine recipient studied (FIG. 140B). IFN-γ ELISPOT responses correlated with S-specific binding antibody titers, RBD-specific binding antibody titers, and neutralizing antibody titers on day 29 (P=0.0045, R=0.5492; P=0.0056, R=0.5378; and P=0.0031, R=0.5676, respectively, two-sided Spearman rank-correlation tests; FIG. 141).

Discussion and Conclusions

We report here a detailed immunologic analysis of 25 individuals who received various regimens of Ad26.COV2.S or placebo in a phase 1 clinical trial. Overall, immunogenicity was comparable with the 810 individuals in the parent study (See Example 27 and Sadoff et al., New Engl. J. Med., in press). We extend these previous results by showing the rapid induction of antibodies by one week following vaccination, with RBD-specific binding antibodies detected in 90% of vaccine recipients by day 8. These data demonstrate that Ad26.COV2.S induces rapid and complex antibody responses with likely durability as well as cellular immune responses following a single immunization.

A central hypothesis for most current COVID-19 vaccine programs is that antibodies against the SARS-CoV-2 S protein are protective. Most programs are therefore focused on strategies that induce virus-specific neutralizing antibodies, but it is possible that other antibody functions may also contribute to protection. Binding, neutralizing, and functional non-neutralizing antibodies all correlated with protective efficacy following DNA and Ad26 vaccination in rhesus macaques (Mercado et al., Nature 586, 583-588 (2020): Yu et al., Science 369, 806-811 (2020)). We recently showed that adoptive transfer of purified IgG from convalescent macaques protected naïve macaques against SARS-CoV-2 challenge in a dose-dependent fashion (Chandrashekar et al., Science 369, 812-817 (2020); McMahan et al., Correlates of protection against SARS-CoV-2 in rhesus macaques. Nature (2020)). S-specific binding antibody titers of 400, RBD-specific binding antibody titers of 100, and neutralizing antibody titers of 50 represented the thresholds for protection in this preclinical model, but correlates of protection have not yet been determined for protection against COVID-19 infection or disease in humans. Nevertheless, it is worth noting that the antibody titers induced in humans by Ad26.COV2.S (FIG. 137) substantially exceed these previously defined thresholds utilizing essentially the same assays. T cell responses may also contribute to protection, particularly in the setting of waning or borderline antibody responses.

Rapid, potent, and durable induction of a diversity of functional antibody responses may be critical for a COVID-19 vaccine. Ad26.COV2.S is highly immunogenic following a single-shot immunization and does not require a subzero frozen cold chain, both of which may provide substantial logistic and practical advantages for mass vaccination campaigns.

By day 8 after initial immunization, binding antibodies rapidly emerged in the majority of vaccine recipients, and neutralizing antibodies were observed in a subset of individuals. Binding and neutralizing antibodies were detected in 100% of vaccine recipients by day 57 after a single immunization. These data demonstrate that Ad26.COV2.S induced antibody responses with rapid kinetics as well as cellular immune responses. Two phase 3 clinical trials are currently underway to determine the efficacy of the Ad26.COV2.S vaccine in humans.

Example 31: A Randomized, Double-Blind, Placebo-Controlled Phase 3 Study to Assess the Efficacy and Safety of Ad26.COV2.S for the Prevention of SARS-CoV-2-Mediated COVID-19 in Adults Aged 18 Years and Older (ENSEMBLE)

This study is an ongoing, randomized, double-blind, placebo-controlled Phase 3, pivotal efficacy, safety and immunogenicity study, conducted in North, Central and South America and South Africa, in adults ≥18 to <60 years of age (Stage 1) and ≥60 years of age (Stage 2), with and without comorbidities that are associated with increased risk of progression to severe COVID-19. The efficacy, safety, and immunogenicity of a single dose of Ad26.COV2.S is being evaluated in participants, living in, or going to locations with high risk for acquisition of SARS CoV 2 infection. Good representation of age and presence/absence of comorbidities in the study population was achieved through stratification at randomization. Efforts were made to also ensure good representation in terms of race, ethnicity, and gender. The co-primary objectives are to demonstrate the efficacy of a single dose of Ad26.COV2.S $5\times10^{10}$ vp in the prevention of molecularly confirmed, moderate to severe/critical COVID-19 with onset at least 14 days and at least 28 days post-vaccination, as compared to placebo, in SARS-CoV-2 seronegative adults. Other key endpoints include efficacy in the prevention of severe/critical COVID-19 (including deaths and medical interventions), efficacy in the prevention of all symptomatic COVID-19 (including mild, moderate and severe/critical disease as measured by a severity-adjusted weighed BOD analysis), and efficacy in adults ≥60 years of age.

This Example describes the efficacy of Ad26.COV2.S evaluated in this Phase 3 study. In this large, multi-country pivotal efficacy study, the vaccine was shown to be efficacious in the prevention of moderate to severe/critical COVID-19 in an adult population that was ethnically and geographically diverse.

The initial planned sample size of 60,000 participants was calculated at the operational cut-off date prior to study start based on the uncertainty of the epidemiological situation in combination with the ability to provide a high probability (approximately 90%) to reach a time to signal within 8 months of the study for a vaccine with an assumed 60% VE. Once it became evident that the incidence of COVID-19 was substantially higher than initially assumed at the start of the study, the sample size was reduced to approximately 40,000 participants.

Identification and molecular confirmation of SARS-CoV-2 infection and symptomatic COVID-19 was performed throughout the study as described in the clinical study protocol. Molecular confirmation of SARS-CoV-2 infection (using the Abbott Real Time SARS-CoV-2 RT-PCR assay [Abbott 2020]) by a central laboratory (University of Washington [UW Virology laboratory]) was used for the analysis of the case definition.

The term severe/critical COVID-19 cases refers to cases that were clinically assessed by a Clinical Severity Adjudication Committee and adjudicated as severe/critical. Classification of severity was based on the highest degree of severity during the observation period. All analysis including severe/critical cases are based on adjudication unless stated otherwise.

The occurrence of COVID-19-related hospitalization and COVID-19-related complications (such as but not limited to hyperinflammatory syndrome, pneumonia, neurological or vascular complications, severe pneumonia, severe neurological or vascular events, acute respiratory distress syndrome, renal complications, sepsis, septic shock, death [WHO 2020d]) was monitored throughout the study.

The primary objective of the COV3001 study was to demonstrate the efficacy of Ad26.COV2.S in the prevention of molecularly confirmed (defined as a positive SARS-CoV-2 viral RNA result by a central laboratory using a PCR-based or other molecular diagnostic test) moderate to severe/critical COVID-19, as compared to placebo, in SARS-CoV-2 seronegative adults. The Full Analyis Set (FAS) comprises all randomized participants who receive at least one vaccine administration.

The Per-Protocol (PP) set comprises a subset of FAS, excluding (i) subjects with major protocol deviations impacting efficacy; (ii) seropositive at baseline (Day 1); (iii) PCR+ at baseline, if available* (Day 1) (*all cases were analyzed for Day 1 PCR).

All efficacy analyses were performed on the PP (per protocol) set unless stated otherwise. The PP set includes participants who received study vaccine and who were seronegative at the time of vaccination and who had no other major protocol deviations that were judged to possibly impact the efficacy of the vaccine.

The primary analysis was supplemented with subgroup analyses for age group (18 to <60 years, ≥60 years) and presence of comorbidities (yes/no) employing a descriptive summary including (unadjusted) 95% CIs to describe the VE in each subpopulation using the same methods.

At the time of the primary analysis the following secondary endpoints were tested:

The VE against all symptomatic COVID-19 with onset at least 28 and at least 14 days after vaccination, evaluated by means of the (Burden of Disease (BOD) endpoint. The BOD evaluates the severity-adjusted VE against preventing symptomatic COVID-19. A higher weight is assigned to severe infections (severe cases receive a score of 2, and non-severe 1) and, as such, the BOD endpoint aims at providing higher statistical power for differentiating from placebo vaccines with increased protection against severe infections., VE against severe/critical COVID-19 with onset at least 28 and/or at least 14 days post vaccination.

The following endpoints were also analyzed descriptively (including 95% CI):

VE against COVID-19 needing medical intervention with onset at least 28 and at least 14 days post vaccination (23 cases with onset from Day 29 and Day 15, respectively, had to be available). COVID-19 needing medical intervention (such as a composite endpoint of hospitalization, ICU admission, mechanical ventilation, and ECMO, linked to objective measures such as decreased oxygenation, X-ray or CT findings) was determined based on Medical Resource Utilization data which were collected through the Medically-attended COVID-19 Form.

VE against all SARS-CoV-2 infections with onset from Day 29 (>15,000 participants had to have a Day 71 sample available).

VE against asymptomatic/or undetected cases with onset from Day 29 (all participants had to have at least 6 months of follow-up).

Other secondary endpoints that are described descriptively include VE against molecularly confirmed mild COVID-19 and against COVID-19 per the US FDA harmonized COVID-19 case definition, subgroup analyses by age, presence/absence of comorbidities, sex, region, country, race, ethnicity and HIV status and viral load after infection. To assess potential time-effects of VE, cumulative incidence plots over time using the Kaplan-Meier methods were used.

Due to the high COVID-19 incidence rate during the conduct of the study, not all cases were confirmed by the central laboratory (UoW) at the time of the primary analysis. There was a high number of cases with symptoms meeting the COVID-19 case definition and at least 1 positive PCR result from another source (local or central). Therefore, the primary analysis is supplemented with a sensitivity analysis including cases with at least one positive PCR result, irrespective of the source of that test. Although the analyses are non-inferential, the same a-level was used as for the respective inferential analyses.

Participant Information:

A total of 43,783 participants were randomized (21,895 in the Ad26.COV2.S $5\times10^{10}$ group and 21,888 in the placebo group), all of whom received study vaccination and 39,321 (19,630 in the Ad26.COV2.S $5\times10^{10}$ group and 19,691 in the placebo group) were included in the PP set. Data presented in this section are for the PP set.

Of the participants in the PP set, none of the participants had completed the study and 130 (0.3%; (41 [0.2%] participants in the Ad26.COV2.S $5\times10^{10}$ group and 89 [0.5%] participants] in the placebo group) had discontinued the study prematurely, mainly due to withdrawal of consent (30 [0.2%] participants and 62 [0.3%] participants, respectively). At the time of the primary analysis, the median follow-up after vaccination was 58 days and 21,491 participants in the PP set had at least 2 months of follow-up.

Study participants who became eligible to receive an authorized/licensed COVID-19 vaccine could request unblinding per protocol. Up to the cutoff date of 22 Jan. 2021, 2, 257 (5.2%) participants were unblinded to receive an authorized/licensed COVID-19 vaccine during the course of this study.

No relevant differences in demographics and baseline characteristics were observed between the Ad26.COV2.S group and the placebo group. Randomization was stratified by site, age and presence/absence of comorbidities and efforts were made to ensure good representation in terms of race, ethnicity, and gender:

Main Findings for Demographics of Study Population:
Age distribution >=60 (33,5%), >=65 (19,6%), >=75 (3,5%), >=80 (1%)
Gender: 45% females, 55% males
Region: 44% US, 41% Central and South America, and 15% South Africa
Race: 19,5% were black or African American (in US 13%)
Comorbidities (overall 41%, obesity (28.5%), type 2 diabetes (7.3%), hypertension (10.3%), HIV (2.8%), also other immunocompromised participants were in the study In the PP set, the majority of participants came from North America (46.7%) and Central and South America (40.6%); the other participants came from South Africa (12.7%). Overall, 62.1% of the participants were White and 17.2% were Black or African American; 8.3% were American Indian/Alaska Native, and 3.5% were Asian; 45.1% of the participants were Hispanic or Latino. In the PP set, 44.5% of participants were female and 55.5% were male. The median age was 53.0 years (range: 18 to 100). The intended enrollment target of a minimum of approximately 30% of participants ≥60 years of age and approximately 20% of participants ≥18 to <40 years of age was reached, with 34.6% of participants ≥60 years of age and 22.2% of participants ≥18 to <40 years of age. In total 20.4% and 3.7% of the participants were ≥65 and ≥75 years of age, respectively. The median body mass index (BMI) was 26.90 kg/m2 (range: 2.3; 82.6 kg/m$^2$). In the full analysis set (FAS, i.e. all randomized participants with a documented study vaccine administration, regardless of the occurrence of protocol deviations and serostatus at enrolment) 9.6% of the participants were SARS-CoV-2 seropositive at baseline. These participants were excluded from the PP set.

Overall in the PP set, 39.9% of the participants had one or more comorbidities associated with increased risk of progression to severe COVID-19 at baseline. Most common comorbidities were obesity (27.5%), hypertension (10.3%), type 2 diabetes mellitus (7.2%), serious heart conditions (2.4%) and asthma (1.3%). Other comorbidities were present in <1% of the participants. HIV-infection was reported at baseline in 2.5% of the participants.

Efficacy Analyses

A summary of efficacy analyses based on the number of COVID-19 cases occurring at least 14 days and at least 28 days after vaccination is presented in Table 1 and Table 2, respectively. In the sections below, vaccine efficacy is described for confirmed COVID-19 cases in seronegative participants, unless clearly specified otherwise. If <6 cases are observed for an endpoint, the VE is not displayed.

Text, tables and figures show the a false positive controlled 95% Confidence Interval (CI) (further referred to as 'adjusted CI') when a statistical hypothesis was evaluated (primary endpoints, VE against any all symptomatic infection [BOD] endpoint, and VE against severe/critical COVID-19 and VE against COVID-19 needing medical intervention), otherwise data are summarized descriptively, using a 95% CI.

For participants with molecularly confirmed COVID-19, the follow-up time is defined as the time between vaccination and the time of onset of the case. For all subjects without confirmed COVID-19, follow-up time is defined as the time since vaccination until the last available measurement (for subjects ongoing in the study) or study discontinuation/completion. Note that, non-confirmed cases are counted as 'no case' in the calculation of follow-up for all analyses, except for the sensitivity analyses including confirmed and non-confirmed cases; in these analyses follow-up of the non-confirmed cases follow-up is defined as the time between vaccination and the time of the positive PCR test from any source.

It is noted that the trial was conducted at the height of the COVID-19 pandemic in 8 countries and three regions, during which disease spread has accelerated throughout the world resulting in people having increased exposure to the virus, and in a time wherein newly emerging strains of coronavirus including some which are more infectious were occurring (see FIG. 145).

TABLE 1

TEFSUM01_A: Summary of Vaccine Efficacy Against COVID-19 with Onset at Least 14 Days After Vaccination; Per Protocol Set (Study VAC31518COV3001)

|  | Ad26 5e10 vp | | Placebo | | | | |
|---|---|---|---|---|---|---|---|
|  | #Cases | (N)/Person-Years | #Cases | (N)/Person-Years | VE | 95% CI | Adjusted 95% CI |
| Analysis set: Per protocol set |  | (19630) |  | (19691) |  |  |  |
| Risk set[a] |  | (19514) |  | (19544) |  |  |  |
| Primary endpoint |  |  |  |  |  |  |  |
| Moderate and severe/critical COV1D-19 | 116 | 3116.57 | 348 | 3096.12 | 66.9% |  | (59.03; 73.40) |
| Age 18-59 years | 95 | 2106.82 | 260 | 2094.97 | 63.7% | (53.87; 71.58) |  |
| Age >= 60 years | 21 | 1009.75 | 88 | 1001.15 | 76.3% | (61.58; 86.04) |  |
| Secondary endpoints |  |  |  |  |  |  |  |
| Any symptomatic COVID-19 severity | 117 | 3116.46 | 351 | 3095.92 | 66.9% | (59.07; 73.37) |  |
| Mild | 1 | 3116.46 | 3 | 3095.92 |  |  |  |
| Moderate | 102 | 3116.57 | 288 | 3096.12 | 64.8% | (55.75; 72.21) |  |
| Severe/critical | 14 | 3125.05 | 60 | 3122.03 | 76.7% |  | (54.56; 89.09) |
| All symptomatic COV1D-19 (BOD)[b] | 117 | 3116.46 | 351 | 3095.92 | 68.1% |  | (60.26; 74.32) |
| Age 18-59 years | 95 | 2106.82 | 260 | 2094.97 | 65.8% | (56.22; 73.10) |  |
| Age >= 60 years | 22 | 1009.64 | 91 | 1000.95 | 74.5% | (57.91; 84.33) |  |
| Req. Medical intervention | 2 | 3125.92 | 8 | 3126.10 | 75.0% | (−25.28; 97.41) |  |
| Supplementary Endpoints |  |  |  |  |  |  |  |
| Primary endpoint including non-confirmed cases | 173 | 3113.88 | 509 | 3089.06 | 66.3% |  | (59.86; 71.79) |
| US FDA Harmonized COVID-19 cases | 114 | 3116.60 | 345 | 3096.30 | 67.2% | (59.32; 73.67) |  |

The adjusted CI implements type I error control for multiple testing and is presented upon meeting the prespecified testing conditions.
If less than 6 cases are observed for an endpoint then the VE will not be shown.
[a]The risk set are all subjects of the Per Protocol Set excluding subjects that had a positive PCR test between day 1 and day 14.
[b]BOD: Burden Of Disease is a weighted version of the mild, moderate, and severe/critical vaccine efficacies.
NE: Not Evaluable

TABLE 2

TEFSUM01_C: Summary of Vaccine Efficacy Against COVID-19 with Onset at Least 28 Days After Vaccination; Per Protocol Set (Study VAC31518COV3001)

| | Ad26 5e10 vp | | Placebo | | | | |
|---|---|---|---|---|---|---|---|
| | #Cases | (N)/Person-Years | #Cases | (N)/Person-Years | VE | 95% CI | Adjusted 95% CI |
| Analysis set: Per protocol set | | (19630) | | (19691) | | | |
| Risk set[a] | | (19306) | | (19178) | | | |
| Primary endpoint | | | | | | | |
| Moderate and severe/critical COVID-19 | 66 | 3102.00 | 193 | 3070.65 | 66.1% | | (55.01; 74.80) |
| Age 18-59 years | 52 | 2097.60 | 152 | 2077.01 | 66.1% | (53.30; 75.77) | |
| Age >= 60 years | 14 | 1004.39 | 41 | 993.64 | 66.2% | (36.74; 82.99) | |
| Secondary endpoints | | | | | | | |
| All SARS-CoV 2 infections | 71 | 3101.59 | 214 | 3069.58 | 67.2% | (56.86; 75.26) | |
| Any symptomatic COVID-19 severity | 66 | 3102.00 | 195 | 3070.53 | 66.5% | (55.50; 75.05) | |
| Mild | 0 | 3102.00 | 2 | 3070.53 | | | |
| Moderate | 61 | 3102.00 | 159 | 3070.65 | 62.0% | (48.68; 72.21) | |
| Severe/critical | 5 | 3106.15 | 34 | 3082.58 | 85.4% | | (54.15; 96.90) |
| Asymptomatic SARS-CoV-2 infections | 5 | 3101.59 | 19 | 3069.58 | 74.0% | (27.89; 92.40) | |
| All symptomatic COVID-19 (BOD)[b] | 66 | 3102.00 | 195 | 3070.53 | 69.0% | | (56.68; 77.64) |
| Age 18-59 years | 52 | 2097.60 | 152 | 2077.01 | 69.3% | (57.42; 77.68) | |
| Age >= 60 years | 14 | 1004.39 | 43 | 993.52 | 67.9% | (38.17; 82.77) | |
| Req. Medical intervention | 0 | 3106.43 | 5 | 3084.42 | | | |
| Supplementary Endpoints | | | | | | | |
| Primary endpoint including non-confirmed cases | 113 | 3100.26 | 324 | 3065.86 | 65.5% | | (57.15; 72.41) |
| US FDA Harmonized COVID-19 cases | 65 | 3102.02 | 193 | 3070.58 | 66.7% | (55.63; 75.23) | |

The adjusted CI implements type I error control for multiple testing and is presented upon meeting the prespecified testing conditions.
If less than 6 cases are observed for an endpoint then the VE will not be shown.
[a]The risk set are all subjects of the Per Protocol Set excluding subjects that had a positive PCR test between day 1 and day 28.
[b]BOD: Burden Of Disease is a weighted version of the mild, moderate, and severe/critical vaccine efficacies.
NE: Not Evaluable Results:

The study generated high quality data in multiple regions (North and South America, Africa) at a time when the incidence of SARS-CoV-2 was very high and new lineages of the virus were emerging.

The study met its co-primary objectives:

A single dose of Ad26.COV2.S vaccine was efficacious in the prevention of moderate to severe/critical COVID-19 with VE of 67% and 66% post Day 14 and post Day 28 post vaccination.

In US, a single dose of Ad26.COV2.S vaccine was efficacious in the prevention of moderate to severe/critical COVID-19 with VE of 77% and 72% post Day 14 and post Day 28 post vaccination.

The onset of efficacy was evident as of day 14, with efficacy increasing through day 56, especially against severe disease. This finding is consistent with available immunogenicity results, with neutralizing and binding antibody titers detected from day 14 onwards, which continued to increase up to day 56 with no indication of waning up to day 84.

Moderate COVID-19 cases in the vaccine group reported fewer symptoms than moderate COVID-19 cases in the placebo group.

The results were consistent when using only PCR+ cases that were confirmed by the central laboratory or when using all PCR+ cases irrespective of confirmation by the central laboratory. Vaccine efficacy increased with severity:

High vaccine efficacy (85% overall, after Day 28) was noted against severe/critical COVID-19 with efficacy observed as early as Day 7 (77% as of Day 14).

This high vaccine efficacy was consistent across countries and regions, including South Africa where almost all cases were due to the new variant of SARS-CoV-2 (B.1.351) (based on partially available sequencing data: 45/48 with B.1.351)

For participants with a COVID-19 episode requiring medical intervention defined as hospitalization, ICU, ECMO or mechanical ventilation, there were 2 cases reported in the vaccinated group versus 8 cases in the placebo group after Day 14 and no cases versus 5 cases after Day 28. Investigation of potential under-reporting is ongoing.

All COVID-19 confirmed deaths (5) occurred in the placebo group.

The co-primary endpoints were the occurrence of confirmed moderate to severe/critical COVID-19 cases in seronegative participants, with onset at least 28 days and at least 14 days after vaccination with Ad26.COV2.S compared to placebo. A successful primary endpoint conclusion required a VE of >30% with a point estimate of ≥50% and a favorable split between the Ad26.COV2.S and placebo group for severe cases with at least 5 cases in the placebo group. At the time of the primary analysis, in the PP set, there were 259 moderate to severe/critical COVID-19 cases which occurred at least 28 days and 464 cases which occurred at least 14 days after vaccination. The prespecified criteria (see above) for a successful primary analysis have been met for both co-primary endpoints and, therefore, efficacy of Ad26.COV2.S against moderate and severe/critical COVID-19 has been established from 14 days after vaccination onwards.

The VE (adjusted 95% CI) against moderate to severe/critical COVID-19 which occurred at least 28 days after vaccination was 66.1% (55.01; 74.80) and 66.9% (59.03; 73.40) when evaluated at least 14 days after vaccination The case split for cases occurring at least 28 days after vaccination was 66 vs 193 in the Ad26.COV2.S group vs the placebo group, respectively. For cases occurring at least 14 days after vaccination there were 116 and 348 cases, respectively. The case split for severe/critical cases occurring at least 28 days and at least 14 days after vaccination was 5 vs 34 and 14 vs 60, respectively Supplemental analyses evaluated the VE against moderate to severe/critical COVID-19 by age category (≥18 to <60 years, ≥60 years). VE (CI) in participants ≥60 years of age was at least equally high compared to adult participants <60 years: 66.2% (36.74; 82.99) and 76.3% (61.58; 86.04) with onset at least 28 days and at least 14 days after vaccination, respectively, in participants >60 years of age and 66.1% (53.30; 75.77) and 63.7% (53.87; 71.58), respectively, in participants <60 years of age. Additional subgroup analyses by baseline SARS-CoV-2 serostatus and demographic and baseline characteristics are discussed below.

The early onset of protection against confirmed moderate to severe/critical COVID-19 is apparent in FIG. 142 and FIG. 143, which display the cumulative incidence for the first occurrence of confirmed moderate to severe/critical COVID-19 with onset at least 1 day after vaccination. The cumulative distribution curves begin to separate between the Ad26.COV2.S and the placebo group around 14 days after vaccination and VE continues to increase up to Day 56 with no indication of waning up to Day 85, which is in line with the finding in the phase1 trial, in which a neutralizing antibody response was observed as of Day 15 onwards, with increasing GMTs and percentage of responders up to Day 57.

Efficacy against severe disease increased over time with no cases in vaccinated participants reported after day 49.

Of the 259 and 464 moderate to severe/critical COVID-19 cases occurring at least 28 days and at least 14 days after vaccination, respectively, 39 and 74 were severe/critical and 220 and 390 were moderate. In addition, up to the cut-off date of the analysis, 2 and 4 mild COVID-19 cases with onset at least 28 and 14 days after vaccination, respectively, were reported.

Vaccine Efficacy Against Severe/Critical COVID-19

Vaccine efficacy against severe/critical COVID-19 was statistically tested against a null hypothesis of VE <0%. The prespecified criterion for success was met based on cases with onset at least 28 days as well as based on cases with onset at least 14 days after vaccination (adjusted 95% CI is >0) and, therefore, the efficacy against severe/critical COVID-19 from 14 days after vaccination onwards has been established. VE (CI) against severe/critical COVID-19 occurring at least 28 days and 14 days after vaccination was 85.4% (54.15; 96.90) and 76.7% (54.56; 89.09), respectively.

The cumulative incidence for the first occurrence of severe/critical COVID-19 with onset at least 1 day after vaccination is displayed in FIG. 144 and demonstrates the early onset of protection against severe/critical COVID-19. The cumulative distribution curves begin to separate between the Ad26.COV2.S and the placebo group around 7 days after vaccination and VE increases up to Day 56.

All confirmed COVID-19 cases in ENSEMBLE requiring medical intervention (hospitalization, ICU admission, mechanical ventilation, ECMO) or resulting in primary death at least 28-days post-vaccination occurred among participants who received placebo.

Vaccine Efficacy Against Moderate and Mild COVID-19

The VE (CI) against moderate COVID19 occurring at least 28 days and at least 14 days after vaccination was 62.0% (48.68; 72.21) and 64.8% (55.75; 72.21), respectively. For mild COVID-19 cases (<6 cases) there was a favorable split between the Ad26.COV2.S and placebo group with 0 and 2 cases, respectively, occurring at least 28 days after vaccination and 1 and 3 cases, respectively, occurring at least 14 days after vaccination.

Table 3: Summary of Vaccine Efficacy Against Moderate COVID-19 with Onset at Least 14 Days After Vaccination; Per Protocol Set By Number of Moderate Symptoms:

Moderate COVID-19 cases in the vaccine group reported fewer symptoms than moderate COVID-19 cases in the placebo group, indicating that in case of breakthrough infections (in the category of 'moderate illness) there were significantly less symptoms in people who got vaccinated than those receiving placebo.

Vaccine Efficacy Against any Symptomatic COVID-19

Considering all symptomatic COVID-19 cases, irrespective of severity, a total of 285 and 468 symptomatic COVID-19 cases with onset at least 28 days after vaccination and at least 14 days after vaccination were reported. The VE against all symptomatic COVID-19 was evaluated by means of the BOD endpoint, which evaluates the severity-adjusted VE against preventing symptomatic COVID-19. A higher weight is assigned to severe infections (severe cases receive a score of 2, and non-severe 1) and, as such, the BOD endpoint aims at providing higher statistical power for differentiating from placebo vaccines with increased protection against severe infections. The VE against all symptomatic COVID-19 occurring at least 28 and at least 14 days after vaccination, measured by the BOD endpoint, was 69.0% (56.68, 77.64) and 68.1% (60.26, 74.32), respectively. As the lower boundary of the adjusted 95% CI is >0 for both endpoints, the prespecified criteria for success were met and, therefore, the efficacy of Ad26.COV2.S against all symptomatic COVID-19 has been established from 14 days after vaccination onwards.

As the VE against severe disease was higher as compared to the VE against moderate and mild disease, the VE against all symptomatic COVID-19, with all severities weighted equally, was slightly lower compared to the severity adjusted VE: 66.5% (55.50; 75.05) and 66.9% (59.07; 73.37) based on cases occurring at least 28 days and at least 14 days after vaccination, respectively.

VE against COVID-19 per the US FDA harmonized definition was in line with the observed VE against all symptomatic COVID-19: 66.7% (55.63; 75.23) and 67.2% (59.32; 73.67) at least 28 days and at least 14 days after vaccination, respectively.

All SARS-CoV-2 Infections Including Asymptomatic or Undetected Cases

The effect of Ad26.COV2.S on the occurrence of confirmed asymptomatic or undetected SARS-CoV-2 infections were assessed using an ELISA and/or SARS-CoV-2 immunoglobulin assay that is dependent on the SARS-CoV-2 N protein. Serologic conversion is being assessed between Day 1 (pre-vaccination) and Day 71, 6 months and 1 year post-vaccination. In addition, serologic conversion is assessed between Day 1 (pre-vaccination) and Day 29 post-vaccination. At the time of the interim analysis, limited data from Day 71 and Day 29 were available. Vaccine efficacy (CI) against asymptomatic COVID-19 infection occurring at least 28 days after vaccination was 74.0% (27.89; 92.40) (see table 5).

TABLE 5

TEFSUM02C: Summary of Vaccine Efficacy Against Asymtomatic/undetected SARS-CoV-2 infections from Day 29 (Study VAC31518COV3001)

|  | Ad26 5e10 vp | | Placebo | | | 95% |
| --- | --- | --- | --- | --- | --- | --- |
|  | # Cases | (N)/Person-Years | # Cases | (N)/Person-Years | VE | CI |
| Analysis set: Per protocol set |  | (19630) |  | (19691) |  |  |
| Risk set |  | (19306) |  | (19178) |  |  |
| Asymptomatic SARA-CoV-2 infections (day > 29)[b] | 5 | 3101.59 | 19 | 3069.58 | 74.0% | (27.89; 92.40) |
| Asymptomatic SARA-CoV-2 infections without previous symptoms (Day > 29)[b,d] | 0 | 3100.95 | 12 | 3069.64 | 100.0% | (64.39; 100.00) |
| Serology Risk set[a] |  | (486) |  | (479) |  |  |
| Sero-converted COVID-19 (Day > 29)[c] | 2 | 132.46 | 16 | 128.88 | 87.8% | (48.27; 98.64) |
| Sero-converted COVID-19 without previous symptoms (Day > 29)[c,d] | 0 | 132.06 | 12 | 128.22 | 100.0% | (65.06; 100.00) |

[a]Serology set: Participants with a non-S protein result available on Day 71
[b]A participant will be considered to have experienced asymptomatic or undetected COVID-19 if the participant does not fulfill the criteria for suspected COVID-19 based on signs and symptoms as detected by the algorithm described in the SAP and has a SARS-CoV-2 positive RT-PCR or molecular test result or develops a positive serology (non-S protein) test
[c]A participant will be considered serologically converted if the participant develops a positive seology (non-S protein) test without a SARS-CoV-2 positive RT-PCR before the positive serology test irrespective of whether previous symptoms occured
[d]Aparticipant is considered without previous symptoms if no COVID-19 symptoms occured before the positive PCR or serology test at any point in time during the study The vaccine efficacy (CI) of Ad26.COV2.S in the prevention of all SARS-CoV-2 infections (combined symptomatic and asymptomatic infections that are serologically and/or molecularly confirmed) with onset at least 28 days after vaccination was 67.2% (56.86; 75.26) (see table 2, above).

Subgroup Analyses

Efficacy analyses against molecularly confirmed moderate to severe/critical COVID-19 with onset at least 28 days and at least 14 days after vaccination by demographic and baseline characteristics including age (18-59 years and ≥60 years), presence/absence of comorbidities (including asthma, cancer, cerebrovascular disease, cystic fibrosis, chronic kidney disease, COPD, serious heart conditions, hypertension, liver disease, neurological conditions, obesity, pulmonary fibrosis, sickle cell anemia, type 1 or type 2 diabetes, or thalassemia) age and comorbidities, sex (male/female), country (Argentina, Brazil, Chile, Colombia, Mexico, Peru, United States, or South Africa), race (American Indian/Alaskan, Asian, Black or African American, native Hawaiian/other, white, multiple), ethnicity (Hispanic/Latino, not-Hispanic/Latino), region (Latin America, Northern America and Southern Africa) and HIV status, are ongoing. Preliminary results are shown below:

Vaccine Efficacy (VE) Against Moderate/Severe Disease and Severe Disease in Subgroups:

Vaccine is efficacious across age groups with estimated vaccine efficacies against moderate/severe disease: at least 64% after Day 14 and at least 66% after Day 28. Vaccine is efficacious among participants with and without co-morbidities, with estimated vaccine efficacies against moderate/severe disease of at least 63% after Day 14 and at least 49% after Day 28 in the group with co-morbidities. Supplementary analysis including all PCR+ regardless of confirmation by the central laboratory shows at least 64% after Day 14 and at least 59% after Day 28. More follow-up data is required to understand observed potential differences between subgroups with and without co-morbidities.

Vaccine efficacy was consistent for Black/African Americans versus Whites and for Hispanics versus non-Hispanics.

Vaccine efficacy against severe disease was evident as of Day 14 and by Day 28 was approximately 85% or more across countries with sufficient data available (South Africa, Colombia).

The level of protection against moderate and severe COVID-19 infection was 72% in the US, 66% in Latin America and 57% in South Africa, 28 days post-vaccination.

Vaccine Efficacy Against Different Virus Strains

During the time of the study, different mutating variants have been identified in the countries that were included in the study. For example, in South Africa the vast majority of strains causing the COVID-19 infections were the variant 501Y.V2 (RSA variant), in particular of the strains (45/48 sequenced), 94% were of the B.1.351 (501Y.V2) SARS-CoV-2 lineage.

Vaccine Efficacy against First Occurrence of Molecularly Confirmed Moderate to Severe/Critical COVID-19 with Onset at Least 28 Days After Vaccination was 67.0 (−8.87-92.24) against variant B1.351 (carrying the 501Y mutation) and against variants carrying the E484K mutation.

Humoral Immunogenicity Following a Single Ad26.COV2.S $5 \times 10^{10}$ vp Dose Up to Day 29

In view of the rise of SARS-CoV-2 virus variants with mutations in the virus S protein in areas that are known targets of neutralizing antibodies, the immunogenicity of Ad26.COV2.S was evaluated against the vaccine insert by S-ELISA at Day 1 and Day 29 post vaccination using samples from two randomly selected Brazilian sites with a high incidence of infection, as well as other random Brazilian, South African and US sites.

Overall, no difference was observed in binding antibody levels induced by Ad26.COV2.S between Brazilian, South African and US participants. Binding antibody concentrations for Brazilian participants (GMCs at Day 29) ranged from 317 (95% CI 227; 444) at Brazilian site BR10003 to 473 (95% CI 268; 836) at Brazilian site BR10004. Binding antibody concentrations for South African and US participants were similar with GMCs at Day 29 of 388 (95% CI 297; 506) and 412 (95% CI 306; 554), respectively.

The responder rates were similar across sites from all 3 countries with >93% for the active vaccine groups, representing geometric mean increases from baseline of more than 6-fold to 9.3-fold.

GMRs (in comparison to US participants) were 0.77 (95% CI 0.49; 1.20) to 1.15 (95% CI 0.64; 2.07) for Brazilian sites, and 0.94 (95% CI 0.63; 1.42) for South African sites.

Similar GMCs were observed across countries compared with COV1001 data.

In summary, in this preliminary analysis it was shown that:

A single dose of Ad26.COV2.S protects against COVID 19 in adults ≥18 years of age, including adults ≥60 years of age. Based on the primary efficacy analysis of this pivotal study, including 19; 630 participants that received Ad26.COV2.S and 19; 691 participants that received placebo, vaccine efficacy (adjusted 95% CI) for the co-primary endpoints against molecularly confirmed moderate to severe/critical COVID-19 in participants who were seronegative at time of vaccination was 66.9% (59.03; 73.40) when considering cases from at least 14 days after vaccination and 66.1% (55.01; 74.80) when considering cases from at least 28 days after vaccination.

VE against severe/critical COVID-19 occurring at least 28 days and 14 days after a single Ad26.COV2.S dose was 85.4% (54.15; 96.90) and 76.7% (54.56; 89.09), respectively, with over 90% efficacy in 18-59 year olds after Day 28. This finding was consistent across countries and regions (North and South America, South Africa), including South Africa where almost all cases were infected with the new variant of SARS-CoV-2 (501Y.V2).

Onset of efficacy was estimated at day 14, with efficacy increasing through day 56, especially against severe disease. This finding is consistent with the immunology finding of neutralizing and binding antibody titers detected from day 14 onwards, which continued to increase up to day 56 with no indication of waning up to day 85.

Vaccine efficacy against all symptomatic disease was consistent with the primary endpoint.

Vaccine efficacy against all symptomatic COVID-19, as measured by a severity-adjusted weighed analysis (BOD) including mild, moderate and severe/critical VE, occurring at least 28 days and at least 14 days after a single Ad26.COV2.S dose was 69.0% and 68.1%, respectively. Efficacy against severe/critical COVID-19 (85.4% and 76.7%) was higher than efficacy against moderate COVID-19 (62.0% and 64.8%), for occurrences at least 28 days and at least 14 days after vaccination, respectively. Non-weighed analysis was consistent with these results.

Vaccine efficacy in the main target populations for COVID-19 vaccination, eg, older adults and (older) adults with comorbidities, is in line with the efficacy observed in the overall population. In general, descriptive subgroup analyses reveal no indication of a difference in Ad26.COV2.S vaccine efficacy across age groups, gender, race/ethnicities, geographies, comorbidities, age combined with comorbidities, at time of vaccination.

Preliminary data suggest a vaccine effect against non-symptomatic infection, as assessed by non-symptomatic PCR+ results and serological conversions. Vaccine efficacy (CI) against asymptomatic COVID-19 infection occurring at least 28 days after vaccination was 74.0% (27.89; 92.40).

In addition, the safety and reactogenicity profile of Ad26.COV2.S is in line with that of the other Ad26-based vaccines. Although the frequency of pyrexia in the Phase 1 and Phase 2

Ad26.COV2.S studies was higher than observed earlier, especially for younger adults, this finding was not reproduced in the larger Phase 3 Ad26.COV2.S study. Ad26.COV2.S reactogenicity is clearly transient and resolves within 1-2 days. Antipyretics may be used post-vaccination for symptom relief as needed.

SEQUENCES

>COR200007_SEQ ID NO: 205

MFVFLVLLPLVSSQCVNLTTRTQLPPAYTNSFTRGVYYPDKVFRSSVLHSTQDLFLPFFSNVTWFHAIHV

SGTNGTKRFDNPVLPFNDGVYFASTEKSNIIRGWIFGTTLDSKTQSLLIVNNATNVVIKVCEFQFCNDPF

LGVYYHKNNKSWMESEFRVYSSANNCTFEYVSQPFLMDLEGKQGNFKNLREFVFKNIDGYFKIYSKHTPI

NLVRDLPQGFSALEPLVDLPIGINITRFQTLLALHRSYLTPGDSSSGWTAGAAAYYVGYLQPRTFLLKYN

ENGTITDAVDCALDPLSETKCTLKSFTVEKGIYQTSNFRVQPTESIVRFPNITNLCPFGEVFNATRFASV

YAWNRKRISNCVADYSVLYNSASFSTFKCYGVSPTKLNDLCFTNVYADSFVIRGDEVRQIAPGQTGKIAD

YNYKLPDDFTGCVIAWNSNNLDSKVGGNYNYLYRLFRKSNLKPFERDISTEIYQAGSTPCNGVEGFNCYF

PLQSYGFQPTNGVGYQPYRVVVLSFELLHAPATVCGPKKSTNLVKNKCVNFNFNGLTGTGVLTESNKKFL

PFQQFGRDIADTTDAVRDPQTLEILDITPCSFGGVSVITPGTNTSNQVAVLYQDVNCTEVPVAIHADQLT

PTWRVYSTGSNVFQTRAGCLIGAEHVNNSYECDIPIGAGICASYQTQTNSPSRAGSVASQSIIAYTMSLG

AENSVAYSNNSIAIPTNFTISVTTEILPVSMTKTSVDCTMYICGDSTECSNLLLQYGSFCTQLNRALTGI

AVEQDKNTQEVFAQVKQIYKTPPIKDFGGFNFSQILPDPSKPSKRSFIEDLLFNKVTLADAGFIKQYGDC

LGDIAARDLICAQKFNGLTVLPPLLTDEMIAQYTSALLAGTITSGWTFGAGAALQIPFAMQMAYRFNGIG

VTQNVLYENQKLIANQFNSAIGKIQDSLSSTASALGKLQDVVNQNAQALNTLVKQLSSNFGAISSVLNDI

LSRLDPPEAEVQIDRLITGRLQSLQTYVTQQLIRAAEIRASANLAATKMSECVLGQSKRVDFCGKGYHLM

SFPQSAPHGVVFLHVTYVPAQEKNFTTAPAICHDGKAHFPREGVFVSNGTHWFVTQRNFYEPQIITTDNT

FVSGNCDVVIGIVNNTVYDPLQPELDSFKEELDKYFKNHTSPDVDLGDISGINASVVNIQKEIDRLNEVA

KNLNESLIDLQELGKYEQYIKWPWYIWLGFIAGLIAIVMVTIMLCCMTSCCSCLKGCCSCGSCCKFDEDD

SEPVLKGVKLHYT

>COR200008_SEQ ID NO: 206

MFVFLVLLPLVSSQCVNLTTRTQLPPAYTNSFTRGVYYPDKVFRSSVLHSTQDLFLPFFSNVTWFHAIHV
SGTNGTKRFDNPVLPFNDGVYFASTEKSNIIRGWIFGTTLDSKTQSLLIVNNATNVVIKVCEFQFCNDPF
LGVYYHKNNKSWMESEFRVYSSANNCTFEYVSQPFLMDLEGKQGNFKNLREFVFKNIDGYFKIYSKHTPI
NLVRDLPQGFSALEPLVDLPIGINITRFQTLLALHRSYLTPGDSSSGWTAGAAAYYVGYLQPRTFLLKYN
ENGTITDAVDCALDPLSETKCTLKSFTVEKGIYQTSNFRVQPTESIVRFPNITNLCPFGEVFNATRFASV
YAWNRKRISNCVADYSVLYNSASFSTFKCYGVSPTKLNDLCFTNVYADSFVIRGDEVRQIAPGQTGKIAD
YNYKLPDDFTGCVIAWNSNNLDSKVGGNYNYLYRLFRKSNLKPFERDISTEIYQAGSTPCNGVEGFNCYF
PLQSYGFQPTNGVGYQPYRVVVLSFELLHAPATVCGPKKSTNLVKNKCVNFNFNGLTGTGVLTESNKKFL
PFQQFGRDIADTTDAVRDPQTLEILDITPCSFGGVSVITPGTNTSNQVAVLYQDVNCTEVPVAIHADQLT
PTWRVYSTGSNVFQTRAGCLIGAEHVNNSYECDIPIGAGICASYQTQTNSPSRAGSVASQSIIAYTMSLG
AENSVAYSNNSIAIPTNFTISVTTEILPVSMTKTSVDCTMYICGDSTECSNLLLQYGSFCTQLNRALTGI
AVEQDKNTQEVFAQVKQIYKTPPIKDFGGFNFSQILPDPSKPSKRSFIEDLLFNKVTLADAGFIKQYGDC
LGDIAARDLICAQKFNGLTVLPPLLTDEMIAQYTSALLAGTITSGWTFGAGAALQIPFAMQMAYRFNGIG
VTQNVLYENQKLIANQFNSAIGKIQDSLSSTASALGKLQDVVNQNAQALNTLVKQLSSNFGAISSVLNDI
LSRLDPPEAEVQIDRLITGRLQSLQTYVTQQLIRAAEIRASANLAATKMSECVLGQSKRVDFCGKGYHLM
SFPQSAPHGVVFLHVTYVPAQEKNFTTAPAICHDGKAHFPREGVFVSNGTHWFVTQRNFYEPQIITTDNT
FVSGNCDVVIGIVNNTVYDPLQPELDSFKEELDKYFKNHTSPDVDLGDISGINASVVNIQKEIDRLNEVA
KNLNESLIDLQELGKYEQYIKWPWYIWLGFIAGLIAIVMVTIMLCCMTSCCSCLKGCCSCGSCCKFDEDD
SEPVLKGV

>COR200009_SEQ ID NO: 207

MDAMKRGLCCVLLLCGAVFVSAQCVNLTTRTQLPPAYTNSFTRGVYYPDKVFRSSVLHSTQDLFLPFFSN
VTWFHAIHVSGTNGTKRFDNPVLPFNDGVYFASTEKSNIIRGWIFGTTLDSKTQSLLIVNNATNVVIKVC
EFQFCNDPFLGVYYHKNNKSWMESEFRVYSSANNCTFEYVSQPFLMDLEGKQGNFKNLREFVFKNIDGYF
KIYSKHTPINLVRDLPQGFSALEPLVDLPIGINITRFQTLLALHRSYLTPGDSSSGWTAGAAAYYVGYLQ
PRTFLLKYNENGTITDAVDCALDPLSETKCTLKSFTVEKGIYQTSNFRVQPTESIVRFPNITNLCPFGEV
FNATRFASVYAWNRKRISNCVADYSVLYNSASFSTFKCYGVSPTKLNDLCFTNVYADSFVIRGDEVRQIA
PGQTGKIADYNYKLPDDFTGCVIAWNSNNLDSKVGGNYNYLYRLFRKSNLKPFERDISTEIYQAGSTPCN
GVEGFNCYFPLQSYGFQPTNGVGYQPYRVVVLSFELLHAPATVCGPKKSTNLVKNKCVNFNFNGLTGTGV
LTESNKKFLPFQQFGRDIADTTDAVRDPQTLEILDITPCSFGGVSVITPGTNTSNQVAVLYQDVNCTEVP
VAIHADQLTPTWRVYSTGSNVFQTRAGCLIGAEHVNNSYECDIPIGAGICASYQTQTNSPRRARSVASQS
IIAYTMSLGAENSVAYSNNSIAIPTNFTISVTTEILPVSMTKTSVDCTMYICGDSTECSNLLLQYGSFCT
QLNRALTGIAVEQDKNTQEVFAQVKQIYKTPPIKDFGGFNFSQILPDPSKPSKRSFIEDLLFNKVTLADA
GFIKQYGDCLGDIAARDLICAQKFNGLTVLPPLLTDEMIAQYTSALLAGTITSGWTFGAGAALQIPFAMQ
MAYRFNGIGVTQNVLYENQKLIANQFNSAIGKIQDSLSSTASALGKLQDVVNQNAQALNTLVKQLSSNFG
AISSVLNDILSRLDKVEAEVQIDRLITGRLQSLQTYVTQQLIRAAEIRASANLAATKMSECVLGQSKRVD
FCGKGYHLMSFPQSAPHGVVFLHVTYVPAQEKNFTTAPAICHDGKAHFPREGVFVSNGTHWFVTQRNFYE
PQIITTDNTFVSGNCDVVIGIVNNTVYDPLQPELDSFKEELDKYFKNHTSPDVDLGDISGINASVVNIQK
EIDRLNEVAKNLNESLIDLQELGKYEQYIKWPWYIWLGFIAGLIAIVMVTIMLCCMTSCCSCLKGCCSCG
SCCKFDEDDSEPVLKGVKLHYT

>COR200010_SEQ ID NO: 208
MDAMKRGLCCVLLLCGAVFVSAQCVNLTTRTQLPPAYTNSFTRGVYYPDKVFRSSVLHSTQDLFLPFFSN
VTWFHAIHVSGTNGTKRFDNPVLPFNDGVYFASTEKSNIIRGWIFGTTLDSKTQSLLIVNNATNVVIKVC
EFQFCNDPFLGVYYHKNNKSWMESEFRVYSSANNCTFEYVSQPFLMDLEGKQGNFKNLREFVFKNIDGYF
KIYSKHTPINLVRDLPQGFSALEPLVDLPIGINITRFQTLLALHRSYLTPGDSSSGWTAGAAAYYVGYLQ
PRTFLLKYNENGTITDAVDCALDPLSETKCTLKSFTVEKGIYQTSNFRVQPTESIVRFPNITNLCPFGEV
FNATRFASVYAWNRKRISNCVADYSVLYNSASFSTFKCYGVSPTKLNDLCFTNVYADSFVIRGDEVRQIA
PGQTGKIADYNYKLPDDFTGCVIAWNSNNLDSKVGGNYNYLYRLFRKSNLKPFERDISTEIYQAGSTPCN
GVEGFNCYFPLQSYGFQPTNGVGYQPYRVVVLSFELLHAPATVCGPKKSTNLVKNKCVNFNFNGLTGTGV
LTESNKKFLPFQQFGRDIADTTDAVRDPQTLEILDITPCSFGGVSVITPGTNTSNQVAVLYQDVNCTEVP
VAIHADQLTPTWRVYSTGSNVFQTRAGCLIGAEHVNNSYECDIPIGAGICASYQTQTNSPSRAGSVASQS
IIAYTMSLGAENSVAYSNNSIAIPTNFTISVTTEILPVSMTKTSVDCTMYICGDSTECSNLLLQYGSFCT
QLNRALTGIAVEQDKNTQEVFAQVKQIYKTPPIKDFGGFNFSQILPDPSKPSKRSFIEDLLFNKVTLADA
GFIKQYGDCLGDIAARDLICAQKFNGLTVLPPLLTDEMIAQYTSALLAGTITSGWTFGAGAALQIPFAMQ
MAYRFNGIGVTQNVLYENQKLIANQFNSAIGKIQDSLSSTASALGKLQDVVNQNAQALNTLVKQLSSNFG
AISSVLNDILSRLDPPEAEVQIDRLITGRLQSLQTYVTQQLIRAAEIRASANLAATKMSECVLGQSKRVD
FCGKGYHLMSFPQSAPHGVVFLHVTYVPAQEKNFTTAPAICHDGKAHFPREGVFVSNGTHWFVTQRNFYE
PQIITTDNTFVSGNCDVVIGIVNNTVYDPLQPELDSFKEELDKYFKNHTSPDVDLGDISGINASVVNIQK
EIDRLNEVAKNLNESLIDLQELGKYEQYIKWPWYIWLGFIAGLIAIVMVTIMLCCMTSCCSCLKGCCSCG
SCCKFDEDDSEPVLKGVKLHYT

>COR200011_SEQ ID NO: 209
MDAMKRGLCCVLLLCGAVFVSAQCVNLTTRTQLPPAYTNSFTRGVYYPDKVFRSSVLHSTQDLFLPFFSN
VTWFHAIHVSGTNGTKRFDNPVLPFNDGVYFASTEKSNIIRGWIFGTTLDSKTQSLLIVNNATNVVIKVC
EFQFCNDPFLGVYYHKNNKSWMESEFRVYSSANNCTFEYVSQPFLMDLEGKQGNFKNLREFVFKNIDGYF
KIYSKHTPINLVRDLPQGFSALEPLVDLPIGINITRFQTLLALHRSYLTPGDSSSGWTAGAAAYYVGYLQ
PRTFLLKYNENGTITDAVDCALDPLSETKCTLKSFTVEKGIYQTSNFRVQPTESIVRFPNITNLCPFGEV
FNATRFASVYAWNRKRISNCVADYSVLYNSASFSTFKCYGVSPTKLNDLCFTNVYADSFVIRGDEVRQIA
PGQTGKIADYNYKLPDDFTGCVIAWNSNNLDSKVGGNYNYLYRLFRKSNLKPFERDISTEIYQAGSTPCN
GVEGFNCYFPLQSYGFQPTNGVGYQPYRVVVLSFELLHAPATVCGPKKSTNLVKNKCVNFNFNGLTGTGV
LTESNKKFLPFQQFGRDIADTTDAVRDPQTLEILDITPCSFGGVSVITPGTNTSNQVAVLYQDVNCTEVP
VAIHADQLTPTWRVYSTGSNVFQTRAGCLIGAEHVNNSYECDIPIGAGICASYQTQTNSPSRAGSVASQS
IIAYTMSLGAENSVAYSNNSIAIPTNFTISVTTEILPVSMTKTSVDCTMYICGDSTECSNLLLQYGSFCT
QLNRALTGIAVEQDKNTQEVFAQVKQIYKTPPIKDFGGFNFSQILPDPSKPSKRSFIEDLLFNKVTLADA
GFIKQYGDCLGDIAARDLICAQKFNGLTVLPPLLTDEMIAQYTSALLAGTITSGWTFGAGAALQIPFAMQ
MAYRFNGIGVTQNVLYENQKLIANQFNSAIGKIQDSLSSTASALGKLQDVVNQNAQALNTLVKQLSSNFG
AISSVLNDILSRLDPPEAEVQIDRLITGRLQSLQTYVTQQLIRAAEIRASANLAATKMSECVLGQSKRVD
FCGKGYHLMSFPQSAPHGVVFLHVTYVPAQEKNFTTAPAICHDGKAHFPREGVFVSNGTHWFVTQRNFYE
PQIITTDNTFVSGNCDVVIGIVNNTVYDPLQPELDSFKEELDKYFKNHTSPDVDLGDISGINASVVNIQK
EIDRLNEVAKNLNESLIDLQELGKYEQYIKWPWYIWLGFIAGLIAIVMVTIMLCCMTSCCSCLKGCCSCG
SCCKFDEDDSEPVLKGV

-continued

>COR200018_SEQ ID NO: 210
MDAMKRGLCCVLLLCGAVFVSASQEIHARFRRFVFLVLLPLVSSQCVNLTTRTQLPPAYTNSFTRGVYYP
DKVFRSSVLHSTQDLFLPFFSNVTWFHAIHVSGTNGTKRFDNPVLPFNDGVYFASTEKSNIIRGWIFGTT
LDSKTQSLLIVNNATNVVIKVCEFQFCNDPFLGVYYHKNNKSWMESEFRVYSSANNCTFEYVSQPFLMDL
EGKQGNFKNLREFVFKNIDGYFKIYSKHTPINLVRDLPQGFSALEPLVDLPIGINITRFQTLLALHRSYL
TPGDSSSGWTAGAAAYYVGYLQPRTFLLKYNENGTITDAVDCALDPLSETKCTLKSFTVEKGIYQTSNFR
VQPTESIVRFPNITNLCPFGEVFNATRFASVYAWNRKRISNCVADYSVLYNSASFSTFKCYGVSPTKLND
LCFTNVYADSFVIRGDEVRQIAPGQTGKIADYNYKLPDDFTGCVIAWNSNNLDSKVGGNYNYLYRLFRKS
NLKPFERDISTEIYQAGSTPCNGVEGFNCYFPLQSYGFQPTNGVGYQPYRVVVLSFELLHAPATVCGPKK
STNLVKNKCVNFNFNGLTGTGVLTESNKKFLPFQQFGRDIADTTDAVRDPQTLEILDITPCSFGGVSVIT
PGTNTSNQVAVLYQDVNCTEVPVAIHADQLTPTWRVYSTGSNVFQTRAGCLIGAEHVNNSYECDIPIGAG
ICASYQTQTNSPRRARSVASQSIIAYTMSLGAENSVAYSNNSIAIPTNFTISVTTEILPVSMTKTSVDCT
MYICGDSTECSNLLLQYGSFCTQLNRALTGIAVEQDKNTQEVFAQVKQIYKTPPIKDFGGFNFSQILPDP
SKPSKRSFIEDLLFNKVTLADAGFIKQYGDCLGDIAARDLICAQKFNGLTVLPPLLTDEMIAQYTSALLA
GTITSGWTFGAGAALQIPFAMQMAYRFNGIGVTQNVLYENQKLIANQFNSAIGKIQDSLSSTASALGKLQ
DVVNQNAQALNTLVKQLSSNFGAISSVLNDILSRLDKVEAEVQIDRLITGRLQSLQTYVTQQLIRAAEIR
ASANLAATKMSECVLGQSKRVDFCGKGYHLMSFPQSAPHGVVFLHVTYVPAQEKNFTTAPAICHDGKAHF
PREGVFVSNGTHWFVTQRNFYEPQIITTDNTFVSGNCDVVIGIVNNTVYDPLQPELDSFKEELDKYFKNH
TSPDVDLGDISGINASVVNIQKEIDRLNEVAKNLNESLIDLQELGKYEQYIKWPWYIWLGFIAGLIAIVM
VTIMLCCMTSCCSCLKGCCSCGSCCKFDEDDSEPVLKGVKLHYT

*Bold and underlined: theoretical signal peptide sequence

>COR200007_SEQ ID NO: 211
ATGTTCGTGTTTCTGGTACTGCTCCCCCTCGTCTCCAGTCAATGCGTGAACCTGACCACAAGAACCCAGC
TGCCTCCAGCCTACACCAACAGCTTTACCAGAGGCGTGTACTACCCCGACAAGGTGTTCAGATCCAGCGT
GCTGCACTCTACCCAGGACCTGTTCCTGCCTTTCTTCAGCAACGTGACCTGGTTCCACGCCATCCACGTG
TCCGGCACCAATGGCACCAAGAGATTCGACAACCCCGTGCTGCCCTTCAACGACGGGGTGTACTTTGCCA
GCACCGAGAAGTCCAACATCATCAGAGGCTGGATCTTCGGCACCACACTGGACAGCAAGACCCAGAGCCT
GCTGATCGTGAACAACGCCACCAACGTGGTCATCAAAGTGTGCGAGTTCCAGTTCTGCAACGACCCCTTC
CTGGGCGTCTACTATCACAAGAACAACAAGAGCTGGATGGAAAGCGAGTTCCGGGTGTACAGCAGCGCCA
ACAACTGCACCTTTGAATACGTGTCCCAGCCTTTCCTGATGGACCTGGAAGGCAAGCAGGGCAACTTCAA
GAACCTGCGCGAGTTCGTGTTCAAGAACATCGACGGCTACTTCAAGATCTACAGCAAGCACACCCCTATC
AACCTCGTGCGGGATCTGCCTCAGGGCTTCTCTGCTCTGGAACCCCTGGTGGATCTGCCCATCGGCATCA
ACATCACCCGGTTTCAGACACTGCTGGCCCTGCACAGAAGCTACCTGACACCTGGCGATAGCAGCAGCGG
ATGGACAGCTGGTGCCGCCGCTTACTATGTGGGCTACCTGCAGCCTAGAACCTTTCTGCTGAAGTACAAC
GAGAACGGCACCATCACCGACGCCGTGGATTGTGCTCTGGATCCTCTGAGCGAGACAAAGTGCACCCTGA
AGTCCTTCACCGTGGAAAAGGGCATCTACCAGACCAGCAACTTCCGGGTGCAGCCCACCGAATCCATCGT
GCGGTTCCCCAATATCACCAATCTGTGCCCCTTCGGCGAGGTGTTCAATGCCACCAGATTCGCCTCTGTG
TACGCCTGGAACCGGAAGCGGATCAGCAATTGCGTGGCCGACTACTCCGTGCTGTACAACTCCGCCAGCT
TCAGCACCTTCAAGTGCTACGGCGTGTCCCCTACCAAGCTGAACGACCTGTGCTTCACAAACGTGTACGC
CGACAGCTTCGTGATCCGGGGAGATGAAGTGCGGCAGATTGCCCCTGGACAGACTGGCAAGATCGCCGAC
TACAACTACAAGCTGCCCGACGACTTCACCGGCTGTGTGATTGCCTGGAACAGCAACAACCTGGACTCCA

-continued

```
AAGTCGGCGGCAACTACAATTACCTGTACCGGCTGTTCCGGAAGTCCAATCTGAAGCCCTTCGAGCGGGA

CATCTCCACCGAGATCTATCAGGCCGGCAGCACCCCTTGTAACGGCGTGGAAGGCTTCAACTGCTACTTC

CCACTGCAGTCCTACGGCTTTCAGCCCACAAATGGCGTGGGCTATCAGCCCTACAGAGTGGTGGTGCTGA

GCTTCGAACTGCTGCATGCCCCTGCCACAGTGTGCGGCCCTAAGAAAAGCACCAATCTCGTGAAGAACAA

ATGCGTGAACTTCAACTTCAACGGCCTGACCGGCACCGGCGTGCTGACAGAGAGCAACAAGAAGTTCCTG

CCATTCCAGCAGTTTGGCCGGGATATCGCCGATACCACAGAGCGCCGTTAGAGATCCCCAGACACTGGAAA

TCCTGGACATCACCCCTTGCAGCTTCGGCGGAGTGTCTGTGATCACCCCTGGCACCAACACCAGCAATCA

GGTGGCAGTGCTGTACCAGGACGTGAACTGTACCGAAGTGCCCGTGGCCATTCACGCCGATCAGCTGACA

CCTACATGGCGGGTGTACTCCACCGGCAGCAATGTGTTTCAGACCAGAGCCGGCTGTCTGATCGGAGCCG

AGCACGTGAACAATAGCTACGAGTGCGACATCCCCATCGGCGCTGGCATCTGTGCCAGCTACCAGACACA

GACAAACAGCCCCAGCAGAGCCGGATCTGTGGCCAGCCAGAGCATCATTGCCTACACAATGTCTCTGGGC

GCCGAGAACAGCGTGGCCTACTCCAACAACTCTATCGCTATCCCCACCAACTTCACCATCAGCGTGACCA

CAGAGATCCTGCCTGTGTCCATGACCAAGACCAGCGTGGACTGCACCATGTACATCGCGGCGATTCCAC

CGAGTGCTCCAACCTGCTGCTGCAGTACGGCAGCTTCTGCACCCAGCTGAATAGAGCCCTGACAGGGATC

GCCGTGGAACAGGACAAGAACACCCAAGAGGTGTTCGCCCAAGTGAAGCAGATCTACAAGACCCCTCCTA

TCAAGGACTTCGGCGGCTTCAATTTCAGCCAGATTCTGCCCGATCCTAGCAAGCCCAGCAAGCGGAGCTT

CATCGAGGACCTGCTGTTCAACAAAGTGACACTGGCCGACGCCGGCTTCATCAAGCAGTATGGCGATTGT

CTGGGCGACATTGCCGCCAGGGATCTGATTTGCGCCCAGAAGTTTAACGGACTGACAGTGCTGCCTCCTC

TGCTGACCGATGAGATGATCGCCCAGTACACATCTGCCCTGCTGGCCGGCACAATCACAAGCGGCTGGAC

ATTTGGAGCTGGCGCCGCTCTGCAGATCCCCTTTGCTATGCAGATGGCCTACCGGTTCAACGGCATCGGA

GTGACCCAGAATGTGCTGTACGAGAACCAGAAGCTGATCGCCAACCAGTTCAACAGCGCCATCGGCAAGA

TCCAGGACAGCCTGAGCAGCACAGCAAGCGCCCTGGGAAAGCTGCAGGACGTGGTCAACCAGAATGCCCA

GGCACTGAACACCCTGGTCAAGCAGCTGTCCTCCAACTTCGGCGCCATCAGCTCTGTGCTGAACGATATC

CTGAGCAGACTGGACCCTCCTGAGGCCGAGGTGCAGATCGACAGACTGATCACCGGAAGGCTGCAGTCCC

TGCAGACCTACGTTACCCAGCAGCTGATCAGAGCCGCCGAGATTAGAGCCTCTGCCAATCTGGCCGCCAC

CAAGATGTCTGAGTGTGTGCTGGGCCAGAGCAAGAGAGTGGACTTTTGCGGCAAGGGCTACCACCTGATG

AGCTTCCCTCAGTCTGCCCCTCACGGCGTGGTGTTTCTGCACGTGACATATGTGCCCGCTCAAGAGAAGA

ATTTCACCACCGCTCCAGCCATCTGCCACGACGGCAAAGCCCACTTTCCTAGAGAAGGCGTGTTCGTGTC

CAACGGCACCCATTGGTTCGTGACACAGCGGAACTTCTACGAGCCCCAGATCATCACCACCGACAACACC

TTCGTGTCTGGCAACTGCGACGTCGTGATCGGCATTGTGAACAATACCGTGTACGACCCTCTGCAGCCCG

AGCTGGACAGCTTCAAAGAGGAACTGGACAAGTACTTTAAGAACCACACAAGCCCCGACGTGGACCTGGG

CGATATCAGCGGAATCAATGCCAGCGTCGTGAACATCCAGAAAGAGATCGACCGGCTGAACGAGGTGGCC

AAGAATCTGAACGAGAGCCTGATCGACCTGCAAGAACTGGGAAAATACGAGCAGTACATCAAGTGGCCTT

GGTACATCTGGCTGGGCTTTATCGCCGGACTGATTGCCATCGTGATGGTCACAATCATGCTGTGTTGCAT

GACCAGCTGCTGTAGCTGCCTGAAGGGCTGTTGTAGCTGTGGCAGCTGCTGCAAGTTCGACGAGGACGAT

TCTGAGCCCGTGCTGAAGGGCGTGAAACTGCACTACACA
```

>COR200008_SEQ ID NO: 212
```
ATGTTCGTGTTTCTGGTACTGCTCCCCCTCGTCTCCAGTCAATGCGTGAACCTGACCACAAGAACCCAGC

TGCCTCCAGCCTACACCAACAGCTTTACCAGAGGCGTGTACTACCCCGACAAGGTGTTCAGATCCAGCGT

GCTGCACTCTACCCAGGACCTGTTCCTGCCTTTCTTCAGCAACGTGACCTGGTTCCACGCCATCCACGTG

TCCGGCACCAATGGCACCAAGAGATTCGACAACCCCGTGCTGCCCTTCAACGACGGGGTGTACTTTGCCA
```

-continued

```
GCACCGAGAAGTCCAACATCATCAGAGGCTGGATCTTCGGCACCACACTGGACAGCAAGACCCAGAGCCT
GCTGATCGTGAACAACGCCACCAACGTGGTCATCAAAGTGTGCGAGTTCCAGTTCTGCAACGACCCCTTC
CTGGGCGTCTACTATCACAAGAACAACAAGAGCTGGATGGAAAGCGAGTTCCGGGTGTACAGCAGCGCCA
ACAACTGCACCTTTGAATACGTGTCCCAGCCTTTCCTGATGGACCTGGAAGGCAAGCAGGGCAACTTCAA
GAACCTGCGCGAGTTCGTGTTCAAGAACATCGACGGCTACTTCAAGATCTACAGCAAGCACACCCCTATC
AACCTCGTGCGGGATCTGCCTCAGGGCTTCTCTGCTCTGGAACCCCTGGTGGATCTGCCCATCGGCATCA
ACATCACCCGGTTTCAGACACTGCTGGCCCTGCACAGAAGCTACCTGACACCTGGCGATAGCAGCAGCGG
ATGGACAGCTGGTGCCGCCGCTTACTATGTGGGCTACCTGCAGCCTAGAACCTTTCTGCTGAAGTACAAC
GAGAACGGCACCATCACCGACGCCGTGGATTGTGCTCTGGATCCTCTGAGCGAGACAAAGTGCACCCTGA
AGTCCTTCACCGTGGAAAAGGGCATCTACCAGACCAGCAACTTCCGGGTGCAGCCCACCGAATCCATCGT
GCGGTTCCCCAATATCACCAATCTGTGCCCCTTCGGCGAGGTGTTCAATGCCACCAGATTCGCCTCTGTG
TACGCCTGGAACCGGAAGCGGATCAGCAATTGCGTGGCCGACTACTCCGTGCTGTACAACTCCGCCAGCT
TCAGCACCTTCAAGTGCTACGGCGTGTCCCCTACCAAGCTGAACGACCTGTGCTTCACAAACGTGTACGC
CGACAGCTTCGTGATCCGGGGAGATGAAGTGCGGCAGATTGCCCCTGGACAGACTGGCAAGATCGCCGAC
TACAACTACAAGCTGCCCGACGACTTCACCGGCTGTGTGATTGCCTGGAACAGCAACAACCTGGACTCCA
AAGTCGGCGGCAACTACAATTACCTGTACCGGCTGTTCCGGAAGTCCAATCTGAAGCCCTTCGAGCGGGA
CATCTCCACCGAGATCTATCAGGCCGGCAGCACCCCTTGTAACGGCGTGGAAGGCTTCAACTGCTACTTC
CCACTGCAGTCCTACGGCTTTCAGCCCACAAATGGCGTGGGCTATCAGCCCTACAGAGTGGTGGTGCTGA
GCTTCGAACTGCTGCATGCCCCTGCCACAGTGTGCGGCCCTAAGAAAAGCACCAATCTCGTGAAGAACAA
ATGCGTGAACTTCAACTTCAACGGCCTGACCGGCACCGGCGTGCTGACAGAGAGCAACAAGAAGTTCCTG
CCATTCCAGCAGTTTGGCCGGGATATCGCCGATACCACAGACGCCGTTAGAGATCCCCAGACACTGGAAA
TCCTGGACATCACCCCTTGCAGCTTCGGCGGAGTGTCTGTGATCACCCCTGGCACCAACACCAGCAATCA
GGTGGCAGTGCTGTACCAGGACGTGAACTGTACCGAAGTGCCCGTGGCCATTCACGCCGATCAGCTGACA
CCTACATGGCGGGTGTACTCCACCGGCAGCAATGTGTTTCAGACCAGAGCCGGCTGTCTGATCGGAGCCG
AGCACGTGAACAATAGCTACGAGTGCGACATCCCCATCGGCGCTGGCATCTGTGCCAGCTACCAGACACA
GACAAACAGCCCCAGCAGAGCCGGATCTGTGGCCAGCCAGAGCATCATTGCCTACACAATGTCTCTGGGC
GCCGAGAACAGCGTGGCCTACTCCAACAACTCTATCGCTATCCCCACCAACTTCACCATCAGCGTGACCA
CAGAGATCCTGCCTGTGTCCATGACCAAGACCAGCGTGGACTGCACCATGTACATCTGCGGCGATTCCAC
CGAGTGCTCCAACCTGCTGCTGCAGTACGGCAGCTTCTGCACCCAGCTGAATAGAGCCCTGACAGGGATC
GCCGTGGAACAGGACAAGAACACCCAAGAGGTGTTCGCCCAAGTGAAGCAGATCTACAAGACCCCTCCTA
TCAAGGACTTCGGCGGCTTCAATTTCAGCCAGATTCTGCCCGATCCTAGCAAGCCCAGCAAGCGGAGCTT
CATCGAGGACCTGCTGTTCAACAAAGTGACACTGGCCGACGCCGGCTTCATCAAGCAGTATGGCGATTGT
CTGGGCGACATTGCCGCCAGGGATCTGATTTGCGCCCAGAAGTTTAACGGACTGACAGTGCTGCCTCCTC
TGCTGACCGATGAGATGATCGCCCAGTACACATCTGCCCTGCTGGCCGGCACAATCACAAGCGGCTGGAC
ATTTGGAGCTGGCGCCGCTCTGCAGATCCCCTTTGCTATGCAGATGGCCTACCGGTTCAACGGCATCGGA
GTGACCCAGAATGTGCTGTACGAGAACCAGAAGCTGATCGCCAACCAGTTCAACAGCGCCATCGGCAAGA
TCCAGGACAGCCTGAGCAGCACAGCAAGCGCCCTGGGAAAGCTGCAGGACGTGGTCAACCAGAATGCCCA
GGCACTGAACACCCTGGTCAAGCAGCTGTCCTCCAACTTCGGCGCCATCAGCTCTGTGCTGAACGATATC
CTGAGCAGACTGGACCCTCCTGAGGCCGAGGTGCAGATCGACAGACTGATCACCGGAAGGCTGCAGTCCC
TGCAGACCTACGTTACCCAGCAGCTGATCAGAGCCGCCGAGATTAGAGCCTCTGCCAATCTGGCCGCCAC
CAAGATGTCTGAGTGTGTGCTGGGCCAGAGCAAGAGAGTGGACTTTTGCGGCAAGGGCTACCACCTGATG
```

```
AGCTTCCCTCAGTCTGCCCCTCACGGCGTGGTGTTTCTGCACGTGACATATGTGCCCGCTCAAGAGAAGA
ATTTCACCACCGCTCCAGCCATCTGCCACGACGGCAAAGCCCACTTTCCTAGAGAAGGCGTGTTCGTGTC
CAACGGCACCCATTGGTTCGTGACACAGCGGAACTTCTACGAGCCCCAGATCATCACCACCGACAACACC
TTCGTGTCTGGCAACTGCGACGTCGTGATCGGCATTGTGAACAATACCGTGTACGACCCTCTGCAGCCCG
AGCTGGACAGCTTCAAAGAGGAACTGGACAAGTACTTTAAGAACCACACAAGCCCCGACGTGGACCTGGG
CGATATCAGCGGAATCAATGCCAGCGTCGTGAACATCCAGAAAGAGATCGACCGGCTGAACGAGGTGGCC
AAGAATCTGAACGAGAGCCTGATCGACCTGCAAGAACTGGGAAAATACGAGCAGTACATCAAGTGGCCTT
GGTACATCTGGCTGGGCTTTATCGCCGGACTGATTGCCATCGTGATGGTCACAATCATGCTGTGTTGCAT
GACCAGCTGCTGTAGCTGCCTGAAGGGCTGTTGTAGCTGTGGCAGCTGCTGCAAGTTCGACGAGGACGAT
TCTGAGCCCGTGCTGAAGGGCGTG
```

>COR200009_SEQ ID NO: 213

```
ATGGACGCTATGAAGAGGGGCCTGTGCTGTGTGCTGCTGCTGTGCGGAGCTGTGTTTGTGTCTGCTCAAT
GCGTGAACCTGACCACAAGAACCCAGCTGCCTCCAGCCTACACCAACAGCTTTACCAGAGGCGTGTACTA
CCCCGACAAGGTGTTCAGATCCAGCGTGCTGCACTCTACCCAGGACCTGTTCCTGCCTTTCTTCAGCAAC
GTGACCTGGTTCCACGCCATCCACGTGTCCGGCACCAATGGCACCAAGAGATTCGACAACCCCGTGCTGC
CCTTCAACGACGGGGTGTACTTTGCCAGCACCGAGAAGTCCAACATCATCAGAGGCTGGATCTTCGGCAC
CACACTGGACAGCAAGACCCAGAGCCTGCTGATCGTGAACAACGCCACCAACGTGGTCATCAAAGTGTGC
GAGTTCCAGTTCTGCAACGACCCCTTCCTGGGCGTCTACTATCACAAGAACAACAAGAGCTGGATGGAAA
GCGAGTTCCGGGTGTACAGCAGCGCCAACAACTGCACCTTTGAATACGTGTCCCAGCCTTTCCTGATGGA
CCTGGAAGGCAAGCAGGGCAACTTCAAGAACCTGCGCGAGTTCGTGTTCAAGAACATCGACGGCTACTTC
AAGATCTACAGCAAGCACACCCCTATCAACCTCGTGCGGGATCTGCCTCAGGGCTTCTCTGCTCTGGAAC
CCCTGGTGGATCTGCCCATCGGCATCAACATCACCCGGTTTCAGACACTGCTGGCCCTGCACAGAAGCTA
CCTGACACCTGGCGATAGCAGCAGCGGATGGACAGCTGGTGCCGCCGCTTACTATGTGGGCTACCTGCAG
CCTAGAACCTTTCTGCTGAAGTACAACGAGAACGGCACCATCACCGACGCCGTGGATTGTGCTCTGGATC
CTCTGAGCGAGACAAAGTGCACCCTGAAGTCCTTCACCGTGGAAAAGGGCATCTACCAGACCAGCAACTT
CCGGGTGCAGCCCACCGAATCCATCGTGCGGTTCCCCAATATCACCAATCTGTGCCCCTTCGGCGAGGTG
TTCAATGCCACCAGATTCGCCTCTGTGTACGCCTGGAACCGGAAGCGGATCAGCAATTGCGTGGCCGACT
ACTCCGTGCTGTACAACTCCGCCAGCTTCAGCACCTTCAAGTGCTACGGCGTGTCCCCTACCAAGCTGAA
CGACCTGTGCTTCACAAACGTGTACGCCGACAGCTTCGTGATCCGGGGAGATGAAGTGCGGCAGATTGCC
CCTGGACAGACTGGCAAGATCGCCGACTACAACTACAAGCTGCCCGACGACTTCACCGGCTGTGTGATTG
CCTGGAACAGCAACAACCTGGACTCCAAAGTCGGCGGCAACTACAATTACCTGTACCGGCTGTTCCGGAA
GTCCAATCTGAAGCCCTTCGAGCGGGACATCTCCACCGAGATCTATCAGGCCGGCAGCACCCCTTGTAAC
GGCGTGGAAGGCTTCAACTGCTACTTCCCACTGCAGTCCTACGGCTTTCAGCCCACAAATGGCGTGGGCT
ATCAGCCCTACAGAGTGGTGGTGCTGAGCTTCGAACTGCTGCATGCCCCTGCCACAGTGTGCGGCCCTAA
GAAAAGCACCAATCTCGTGAAGAACAAATGCGTGAACTTCAACTTCAACGGCCTGACCGGCACCGGCGTG
CTGACAGAGAGCAACAAGAAGTTCCTGCCATTCCAGCAGTTTGGCCGGGATATCGCCGATACCACAGACG
CCGTTAGAGATCCCCAGACACTGGAAATCCTGGACATCACCCCTTGCAGCTTCGGCGGAGTGTCTGTGAT
CACCCCTGGCACCAACACCAGCAATCAGGTGGCAGTGCTGTACCAGGACGTGAACTGTACCGAAGTGCCC
GTGGCCATTCACGCCGATCAGCTGACACCTACATGGCGGGTGTACTCCACCGGCAGCAATGTGTTTCAGA
CCAGAGCCGGCTGTCTGATCGGAGCCGAGCACGTGAACAATAGCTACGAGTGCGACATCCCCATCGGCGC
TGGCATCTGTGCCAGCTACCAGACACAGACAAACAGCCCCAGACGGGCCAGATCTGTGGCCAGCCAGAGC
```

-continued

```
ATCATTGCCTACACAATGTCTCTGGGCGCCGAGAACAGCGTGGCCTACTCCAACAACTCTATCGCTATCC

CCACCAACTTCACCATCAGCGTGACCACAGAGATCCTGCCTGTGTCCATGACCAAGACCAGCGTGGACTG

CACCATGTACATCTGCGGCGATTCCACCGAGTGCTCCAACCTGCTGCTGCAGTACGGCAGCTTCTGCACC

CAGCTGAATAGAGCCCTGACAGGGATCGCCGTGGAACAGGACAAGAACACCCAAGAGGTGTTCGCCCAAG

TGAAGCAGATCTACAAGACCCCTCCTATCAAGGACTTCGGCGGCTTCAATTTCAGCCAGATTCTGCCCGA

TCCTAGCAAGCCCAGCAAGCGGAGCTTCATCGAGGACCTGCTGTTCAACAAAGTGACACTGGCCGACGCC

GGCTTCATCAAGCAGTATGGCGATTGTCTGGGCGACATTGCCGCCAGGGATCTGATTTGCGCCCAGAAGT

TTAACGGACTGACAGTGCTGCCTCCTCTGCTGACCGATGAGATGATCGCCCAGTACACATCTGCCCTGCT

GGCCGGCACAATCACAAGCGGCTGGACATTTGGAGCTGGCGCCGCTCTGCAGATCCCCTTTGCTATGCAG

ATGGCCTACCGGTTCAACGGCATCGGAGTGACCCAGAATGTGCTGTACGAGAACCAGAAGCTGATCGCCA

ACCAGTTCAACAGCGCCATCGGCAAGATCCAGGACAGCCTGAGCAGCACAGCAAGCGCCCTGGGAAAGCT

GCAGGACGTGGTCAACCAGAATGCCCAGGCACTGAACACCCTGGTCAAGCAGCTGTCCTCCAACTTCGGC

GCCATCAGCTCTGTGCTGAACGATATCCTGAGCAGACTGGACAAGGTGGAAGCCGAGGTGCAGATCGACA

GACTGATCACCGGAAGGCTGCAGTCCCTGCAGACCTACGTTACCCAGCAGCTGATCAGAGCCGCCGAGAT

TAGAGCCTCTGCCAATCTGGCCGCCACCAAGATGTCTGAGTGTGTGCTGGGCCAGAGCAAGAGAGTGGAC

TTTTGCGGCAAGGGCTACCACCTGATGAGCTTCCCTCAGTCTGCCCCTCACGGCGTGGTGTTTCTGCACG

TGACATATGTGCCCGCTCAAGAGAAGAATTTCACCACCGCTCCAGCCATCTGCCACGACGGCAAAGCCCA

CTTTCCTAGAGAAGGCGTGTTCGTGTCCAACGGCACCCATTGGTTCGTGACACAGCGGAACTTCTACGAG

CCCCAGATCATCACCACCGACAACACCTTCGTGTCTGGCAACTGCGACGTCGTGATCGGCATTGTGAACA

ATACCGTGTACGACCCTCTGCAGCCCGAGCTGGACAGCTTCAAAGAGGAACTGGACAAGTACTTTAAGAA

CCACACAAGCCCCGACGTGGACCTGGGCGATATCAGCGGAATCAATGCCAGCGTCGTGAACATCCAGAAA

GAGATCGACCGGCTGAACGAGGTGGCCAAGAATCTGAACGAGAGCCTGATCGACCTGCAAGAACTGGGAA

AATACGAGCAGTACATCAAGTGGCCTTGGTACATCTGGCTGGGCTTTATCGCCGGACTGATTGCCATCGT

GATGGTCACAATCATGCTGTGTTGCATGACCAGCTGCTGTAGCTGCCTGAAGGGCTGTTGTAGCTGTGGC

AGCTGCTGCAAGTTCGACGAGGACGATTCTGAGCCCGTGCTGAAGGGCGTGAAACTGCACTACACA
```

>COR200010_SEQ ID NO: 214
```
ATGGACGCTATGAAGAGGGGCCTGTGCTGTGTGCTGCTGCTGTGCGGAGCTGTGTTTGTGTCTGCTCAAT

GCGTGAACCTGACCACAAGAACCCAGCTGCCTCCAGCCTACACCAACAGCTTTACCAGAGGCGTGTACTA

CCCCGACAAGGTGTTCAGATCCAGCGTGCTGCACTCTACCCAGGACCTGTTCCTGCCTTTCTTCAGCAAC

GTGACCTGGTTCCACGCCATCCACGTGTCCGGCACCAATGGCACCAAGAGATTCGACAACCCCGTGCTGC

CCTTCAACGACGGGGTGTACTTTGCCAGCACCGAGAAGTCCAACATCATCAGAGGCTGGATCTTCGGCAC

CACACTGGACAGCAAGACCCAGAGCCTGCTGATCGTGAACAACGCCACCAACGTGGTCATCAAAGTGTGC

GAGTTCCAGTTCTGCAACGACCCCTTCCTGGGCGTCTACTATCACAAGAACAACAAGAGCTGGATGGAAA

GCGAGTTCCGGGTGTACAGCAGCGCCAACAACTGCACCTTTGAATACGTGTCCCAGCCTTTCCTGATGGA

CCTGGAAGGCAAGCAGGGCAACTTCAAGAACCTGCGCGAGTTCGTGTTCAAGAACATCGACGGCTACTTC

AAGATCTACAGCAAGCACACCCCTATCAACCTCGTGCGGGATCTGCCTCAGGGCTTCTCTGCTCTGGAAC

CCCTGGTGGATCTGCCCATCGGCATCAACATCACCCGGTTTCAGACACTGCTGGCCCTGCACAGAAGCTA

CCTGACACCTGGCGATAGCAGCAGCGGATGGACAGCTGGTGCCGCCGCTTACTATGTGGGCTACCTGCAG

CCTAGAACCTTTCTGCTGAAGTACAACGAGAACGGCACCATCACCGACGCCGTGGATTGTGCTCTGGATC

CTCTGAGCGAGACAAAGTGCACCCTGAAGTCCTTCACCGTGGAAAAGGGCATCTACCAGACCAGCAACTT

CCGGGTGCAGCCCACCGAATCCATCGTGCGGTTCCCCAATATCACCAATCTGTGCCCCTTCGGCGAGGTG
```

-continued

```
TTCAATGCCACCAGATTCGCCTCTGTGTACGCCTGGAACCGGAAGCGGATCAGCAATTGCGTGGCCGACT
ACTCCGTGCTGTACAACTCCGCCAGCTTCAGCACCTTCAAGTGCTACGGCGTGTCCCCTACCAAGCTGAA
CGACCTGTGCTTCACAAACGTGTACGCCGACAGCTTCGTGATCCGGGGAGATGAAGTGCGGCAGATTGCC
CCTGGACAGACTGGCAAGATCGCCGACTACAACTACAAGCTGCCCGACGACTTCACCGGCTGTGTGATTG
CCTGGAACAGCAACAACCTGGACTCCAAAGTCGGCGGCAACTACAATTACCTGTACCGGCTGTTCCGGAA
GTCCAATCTGAAGCCCTTCGAGCGGGACATCTCCACCGAGATCTATCAGGCCGGCAGCACCCCTTGTAAC
GGCGTGGAAGGCTTCAACTGCTACTTCCCACTGCAGTCCTACGGCTTTCAGCCCACAAATGGCGTGGGCT
ATCAGCCCTACAGAGTGGTGGTGCTGAGCTTCGAACTGCTGCATGCCCCTGCCACAGTGTGCGGCCCTAA
GAAAAGCACCAATCTCGTGAAGAACAAATGCGTGAACTTCAACTTCAACGGCCTGACCGGCACCGGCGTG
CTGACAGAGAGCAACAAGAAGTTCCTGCCATTCCAGCAGTTTGGCCGGGATATCGCCGATACCACAGACG
CCGTTAGAGATCCCCAGACACTGGAAATCCTGGACATCACCCCTTGCAGCTTCGGCGGAGTGTCTGTGAT
CACCCCTGGCACCAACACCAGCAATCAGGTGGCAGTGCTGTACCAGGACGTGAACTGTACCGAAGTGCCC
GTGGCCATTCACGCCGATCAGCTGACACCTACATGGCGGGTGTACTCCACCGGCAGCAATGTGTTTCAGA
CCAGAGCCGGCTGTCTGATCGGAGCCGAGCACGTGAACAATAGCTACGAGTGCGACATCCCCATCGGCGC
TGGCATCTGTGCCAGCTACCAGACACAGACAAACAGCCCCAGCAGAGCCGGATCTGTGGCCAGCCAGAGC
ATCATTGCCTACACAATGTCTCTGGGCGCCGAGAACAGCGTGGCCTACTCCAACAACTCTATCGCTATCC
CCACCAACTTCACCATCAGCGTGACCACAGAGATCCTGCCTGTGTCCATGACCAAGACCAGCGTGGACTG
CACCATGTACATCTGCGGCGATTCCACCGAGTGCTCCAACCTGCTGCTGCAGTACGCCAGCTTCTGCACC
CAGCTGAATAGAGCCCTGACAGGGATCGCCGTGGAACAGGACAAGAACACCCAAGAGGTGTTCGCCCAAG
TGAAGCAGATCTACAAGACCCCTCCTATCAAGGACTTCGGCGGCTTCAATTTCAGCCAGATTCTGCCCGA
TCCTAGCAAGCCCAGCAAGCGGAGCTTCATCGAGGACCTGCTGTTCAACAAAGTGACACTGGCCGACGCC
GGCTTCATCAAGCAGTATGGCGATTGTCTGGGCGACATTGCCGCCAGGGATCTGATTTGCGCCCAGAAGT
TTAACGGACTGACAGTGCTGCCTCCTCTGCTGACCGATGAGATGATCGCCCAGTACACATCTGCCCTGCT
GGCCGGCACAATCACAAGCGGCTGGACATTTGGAGCTGGCGCCGCTCTGCAGATCCCCTTTGCTATGCAG
ATGGCCTACCGGTTCAACGGCATCGGAGTGACCCAGAATGTGCTGTACGAGAACCAGAAGCTGATCGCCA
ACCAGTTCAACAGCGCCATCGGCAAGATCCAGGACAGCCTGAGCAGCACAGCAAGCGCCCTGGGAAAGCT
GCAGGACGTGGTCAACCAGAATGCCCAGGCACTGAACACCCTGGTCAAGCAGCTGTCCTCCAACTTCGGC
GCCATCAGCTCTGTGCTGAACGATATCCTGAGCAGACTGGACCCTCCTGAGGCCGAGGTGCAGATCGACA
GACTGATCACCGGAAGGCTGCAGTCCCTGCAGACCTACGTTACCCAGCAGCTGATCAGAGCCGCCGAGAT
TAGAGCCTCTGCCAATCTGGCCGCCACCAAGATGTCTGAGTGTGTGCTGGGCCAGAGCAAGAGAGTGGAC
TTTTGCGGCAAGGGCTACCACCTGATGAGCTTCCCTCAGTCTGCCCCTCACGGCGTGGTGTTTCTGCACG
TGACATATGTGCCCGCTCAAGAGAAGAATTTCACCACCGCTCCAGCCATCTGCCACGACGGCAAAGCCCA
CTTTCCTAGAGAAGGCGTGTTCGTGTCCAACGGCACCCATTGGTTCGTGACACAGCGGAACTTCTACGAG
CCCCAGATCATCACCACCGACAACACCTTCGTGTCTGGCAACTGCGACGTCGTGATCGGCATTGTGAACA
ATACCGTGTACGACCCTCTGCAGCCCGAGCTGGACAGCTTCAAAGAGGAACTGGACAAGTACTTTAAGAA
CCACACAAGCCCCGACGTGGACCTGGGCGATATCAGCGGAATCAATGCCAGCGTCGTGAACATCCAGAAA
GAGATCGACCGGCTGAACGAGGTGGCCAAGAATCTGAACGAGAGCCTGATCGACCTGCAAGAACTGGGAA
AATACGAGCAGTACATCAAGTGGCCTTGGTACATCTGGCTGGGCTTTATCGCCGGACTGATTGCCATCGT
GATGGTCACAATCATGCTGTGTTGCATGACCAGCTGCTGTAGCTGCCTGAAGGGCTGTTGTAGCTGTGGC
AGCTGCTGCAAGTTCGACGAGGACGATTCTGAGCCCGTGCTGAAGGGCGTGAAACTGCACTACACA
```

>COR200011_SEQ ID NO: 215
ATGGACGCTATGAAGAGGGGCCTGTGCTGTGTGCTGCTGCTGTGCGGAGCTGTGTTTGTGTCTGCTCAAT

GCGTGAACCTGACCACAAGAACCCAGCTGCCTCCAGCCTACACCAACAGCTTTACCAGAGGCGTGTACTA

CCCCGACAAGGTGTTCAGATCCAGCGTGCTGCACTCTACCCAGGACCTGTTCCTGCCTTTCTTCAGCAAC

GTGACCTGGTTCCACGCCATCCACGTGTCCGGCACCAATGGCACCAAGAGATTCGACAACCCCGTGCTGC

CCTTCAACGACGGGGTGTACTTTGCCAGCACCGAGAAGTCCAACATCATCAGAGGCTGGATCTTCGGCAC

CACACTGGACAGCAAGACCCAGAGCCTGCTGATCGTGAACAACGCCACCAACGTGGTCATCAAAGTGTGC

GAGTTCCAGTTCTGCAACGACCCCTTCCTGGGCGTCTACTATCACAAGAACAACAAGAGCTGGATGGAAA

GCGAGTTCCGGGTGTACAGCAGCGCCAACAACTGCACCTTTGAATACGTGTCCCAGCCTTTCCTGATGGA

CCTGGAAGGCAAGCAGGGCAACTTCAAGAACCTGCGCGAGTTCGTGTTCAAGAACATCGACGGCTACTTC

AAGATCTACAGCAAGCACACCCCTATCAACCTCGTGCGGGATCTGCCTCAGGGCTTCTCTGCTCTGGAAC

CCCTGGTGGATCTGCCCATCGGCATCAACATCACCCGGTTTCAGACACTGCTGGCCCTGCACAGAAGCTA

CCTGACACCTGGCGATAGCAGCAGCGGATGGACAGCTGGTGCCGCCGCTTACTATGTGGGCTACCTGCAG

CCTAGAACCTTTCTGCTGAAGTACAACGAGAACGGCACCATCACCGACGCCGTGGATTGTGCTCTGGATC

CTCTGAGCGAGACAAAGTGCACCCTGAAGTCCTTCACCGTGGAAAAGGGCATCTACCAGACCAGCAACTT

CCGGGTGCAGCCCACCGAATCCATCGTGCGGTTCCCCAATATCACCAATCTGTGCCCCTTCGGCGAGGTG

TTCAATGCCACCAGATTCGCCTCTGTGTACGCCTGGAACCGGAAGCGGATCAGCAATTGCGTGGCCGACT

ACTCCGTGCTGTACAACTCCGCCAGCTTCAGCACCTTCAAGTGCTACGGCGTGTCCCCTACCAAGCTGAA

CGACCTGTGCTTCACAAACGTGTACGCCGACAGCTTCGTGATCCGGGGAGATGAAGTGCGGCAGATTGCC

CCTGGACAGACTGGCAAGATCGCCGACTACAACTACAAGCTGCCCGACGACTTCACCGGCTGTGTGATTG

CCTGGAACAGCAACAACCTGGACTCCAAAGTCGGCGGCAACTACAATTACCTGTACCGGCTGTTCCGGAA

GTCCAATCTGAAGCCCTTCGAGCGGGACATCTCCACCGAGATCTATCAGGCCGGCAGCACCCCTTGTAAC

GGCGTGGAAGGCTTCAACTGCTACTTCCCACTGCAGTCCTACGGCTTTCAGCCCACAAATGGCGTGGGCT

ATCAGCCCTACAGAGTGGTGGTGCTGAGCTTCGAACTGCTGCATGCCCCTGCCACAGTGTGCGGCCCTAA

GAAAAGCACCAATCTCGTGAAGAACAAATGCGTGAACTTCAACTTCAACGGCCTGACCGGCACCGGCGTG

CTGACAGAGAGCAACAAGAAGTTCCTGCCATTCCAGCAGTTTGGCCGGGATATCGCCGATACCACAGACG

CCGTTAGAGATCCCCAGACACTGGAAATCCTGGACATCACCCCTTGCAGCTTCGGCGGAGTGTCTGTGAT

CACCCCTGGCACCAACACCAGCAATCAGGTGGCAGTGCTGTACCAGGACGTGAACTGTACCGAAGTGCCC

GTGGCCATTCACGCCGATCAGCTGACACCTACATGGCGGGTGTACTCCACCGGCAGCAATGTGTTTCAGA

CCAGAGCCGGCTGTCTGATCGGAGCCGAGCACGTGAACAATAGCTACGAGTGCGACATCCCCATCGGCGC

TGGCATCTGTGCCAGCTACCAGACACAGACAAACAGCCCCAGCAGAGCCGGATCTGTGGCCAGCCAGAGC

ATCATTGCCTACACAATGTCTCTGGGCGCCGAGAACAGCGTGGCCTACTCCAACAACTCTATCGCTATCC

CCACCAACTTCACCATCAGCGTGACCACAGAGATCCTGCCTGTGTCCATGACCAAGACCAGCGTGGACTG

CACCATGTACATCTGCGGCGATTCCACCGAGTGCTCCAACCTGCTGCTGCAGTACGGCAGCTTCTGCACC

CAGCTGAATAGAGCCCTGACAGGGATCGCCGTGGAACAGGACAAGAACACCCAAGAGGTGTTCGCCCAAG

TGAAGCAGATCTACAAGACCCCTCCTATCAAGGACTTCGGCGGCTTCAATTTCAGCCAGATTCTGCCCGA

TCCTAGCAAGCCCAGCAAGCGGAGCTTCATCGAGGACCTGCTGTTCAACAAAGTGACACTGGCCGACGCC

GGCTTCATCAAGCAGTATGGCGATTGTCTGGGCGACATTGCCGCCAGGGATCTGATTTGCGCCCAGAAGT

TTAACGGACTGACAGTGCTGCCTCCTCTGCTGACCGATGAGATGATCGCCCAGTACACATCTGCCCTGCT

GGCCGGCACAATCACAAGCGGCTGGACATTTGGAGCTGGCGCCGCTCTGCAGATCCCCTTTGCTATGCAG

ATGGCCTACCGGTTCAACGGCATCGGAGTGACCCAGAATGTGCTGTACGAGAACCAGAAGCTGATCGCCA

-continued
ACCAGTTCAACAGCGCCATCGGCAAGATCCAGGACAGCCTGAGCAGCACAGCAAGCGCCCTGGGAAAGCT
GCAGGACGTGGTCAACCAGAATGCCCAGGCACTGAACACCCTGGTCAAGCAGCTGTCCTCCAACTTCGGC
GCCATCAGCTCTGTGCTGAACGATATCCTGAGCAGACTGGACCCTCCTGAGGCCGAGGTGCAGATCGACA
GACTGATCACCGGAAGGCTGCAGTCCCTGCAGACCTACGTTACCCAGCAGCTGATCAGAGCCGCCGAGAT
TAGAGCCTCTGCCAATCTGGCCGCCACCAAGATGTCTGAGTGTGTGCTGGGCCAGAGCAAGAGAGTGGAC
TTTTGCGGCAAGGGCTACCACCTGATGAGCTTCCCTCAGTCTGCCCCTCACGGCGTGGTGTTTCTGCACG
TGACATATGTGCCCGCTCAAGAGAAGAATTTCACCACCGCTCCAGCCATCTGCCACGACGGCAAAGCCCA
CTTTCCTAGAGAAGGCGTGTTCGTGTCCAACGGCACCCATTGGTTCGTGACACAGCGGAACTTCTACGAG
CCCCAGATCATCACCACCGACAACACCTTCGTGTCTGGCAACTGCGACGTCGTGATCGGCATTGTGAACA
ATACCGTGTACGACCCTCTGCAGCCCGAGCTGGACAGCTTCAAAGAGGAACTGGACAAGTACTTTAAGAA
CCACACAAGCCCCGACGTGGACCTGGGCGATATCAGCGGAATCAATGCCAGCGTCGTGAACATCCAGAAA
GAGATCGACCGGCTGAACGAGGTGGCCAAGAATCTGAACGAGAGCCTGATCGACCTGCAAGAACTGGGAA
AATACGAGCAGTACATCAAGTGGCCTTGGTACATCTGGCTGGGCTTTATCGCCGGACTGATTGCCATCGT
GATGGTCACAATCATGCTGTGTTGCATGACCAGCTGCTGTAGCTGCCTGAAGGGCTGTTGTAGCTGTGGC
AGCTGCTGCAAGTTCGACGAGGACGATTCTGAGCCCGTGCTGAAGGGCGTG >COR200018_SEQ ID NO: 216
ATGGACGCTATGAAGAGGGGCCTGTGCTGTGTGCTGCTGCTGTGCGGAGCTGTGTTTGTGTCTGCTAGCC
AAGAGATCCACGCCAGATTTCGGAGATTCGTGTTTCTGGTGCTGCTGCCTCTGGTGTCCAGCCAATGCGT
GAACCTGACCACAAGAACCCAGCTGCCTCCAGCCTACACCAACAGCTTTACCAGAGGCGTGTACTACCCC
GACAAGGTGTTCAGATCCAGCGTGCTGCACTCTACCCAGGACCTGTTCCTGCCTTTCTTCAGCAACGTGA
CCTGGTTCCACGCCATCCACGTGTCCGGCACCAATGGCACCAAGAGATTCGACAACCCCGTGCTGCCCTT
CAACGACGGGGTGTACTTTGCCAGCACCGAGAAGTCCAACATCATCAGAGGCTGGATCTTCGGCACCACA
CTGGACAGCAAGACCCAGAGCCTGCTGATCGTGAACAACGCCACCAACGTGGTCATCAAAGTGTGCGAGT
TCCAGTTCTGCAACGACCCCTTCCTGGGCGTCTACTATCACAAGAACAACAAGAGCTGGATGGAAAGCGA
GTTCCGGGTGTACAGCAGCGCCAACAACTGCACCTTTGAATACGTGTCCCAGCCTTTCCTGATGGACCTG
GAAGGCAAGCAGGGCAACTTCAAGAACCTGCGCGAGTTCGTGTTCAAGAACATCGACGGCTACTTCAAGA
TCTACAGCAAGCACACCCCTATCAACCTCGTGCGGGATCTGCCTCAGGGCTTCTCTGCTCTGGAACCCCT
GGTGGATCTGCCCATCGGCATCAACATCACCCGGTTTCAGACACTGCTGGCCCTGCACAGAAGCTACCTG
ACACCTGGCGATAGCAGCAGCGGATGGACAGCTGGTGCCGCCGCTTACTATGTGGGCTACCTGCAGCCTA
GAACCTTTCTGCTGAAGTACAACGAGAACGGCACCATCACCGACGCCGTGGATTGTGCTCTGGATCCTCT
GAGCGAGACAAAGTGCACCCTGAAGTCCTTCACCGTGGAAAAGGGCATCTACCAGACCAGCAACTTCCGG
GTGCAGCCCACCGAATCCATCGTGCGGTTCCCCAATATCACCAATCTGTGCCCCTTCGGCGAGGTGTTCA
ATGCCACCAGATTCGCCTCTGTGTACGCCTGGAACCGGAAGCGGATCAGCAATTGCGTGGCCGACTACTC
CGTGCTGTACAACTCCGCCAGCTTCAGCACCTTCAAGTGCTACGGCGTGTCCCCTACCAAGCTGAACGAC
CTGTGCTTCACAAACGTGTACGCCGACAGCTTCGTGATCCGGGGAGATGAAGTGCGGCAGATTGCCCCTG
GACAGACTGGCAAGATCGCCGACTACAACTACAAGCTGCCCGACGACTTCACCGGCTGTGTGATTGCCTG
GAACAGCAACAACCTGGACTCCAAAGTCGGCGGCAACTACAATTACCTGTACCGGCTGTTCCGGAAGTCC
AATCTGAAGCCCTTCGAGCGGGACATCTCCACCGAGATCTATCAGGCCGGCAGCACCCCTTGTAACGGCG
TGGAAGGCTTCAACTGCTACTTCCCACTGCAGTCCTACGGCTTTCAGCCCACAAATGGCGTGGGCTATCA
GCCCTACAGAGTGGTGGTGCTGAGCTTCGAACTGCTGCATGCCCCTGCCACAGTGTGCGGCCCTAAGAAA
AGCACCAATCTCGTGAAGAACAAATGCGTGAACTTCAACTTCAACGGCCTGACCGGCACCGGCGTGCTGA -continued

CAGAGAGCAACAAGAAGTTCCTGCCATTCCAGCAGTTTGGCCGGGATATCGCCGATACCACAGACGCCGT

TAGAGATCCCCAGACACTGGAAATCCTGGACATCACCCCTTGCAGCTTCGGCGGAGTGTCTGTGATCACC

CCTGGCACCAACACCAGCAATCAGGTGGCAGTGCTGTACCAGGACGTGAACTGTACCGAAGTGCCCGTGG

CCATTCACGCCGATCAGCTGACACCTACATGGCGGGTGTACTCCACCGGCAGCAATGTGTTTCAGACCAG

AGCCGGCTGTCTGATCGGAGCCGAGCACGTGAACAATAGCTACGAGTGCGACATCCCCATCGGCGCTGGC

ATCTGTGCCAGCTACCAGACACAGACAAACAGCCCCAGACGGGCCAGATCTGTGGCCAGCCAGAGCATCA

TTGCCTACACAATGTCTCTGGGCGCCGAGAACAGCGTGGCCTACTCCAACAACTCTATCGCTATCCCCAC

CAACTTCACCATCAGCGTGACCACAGAGATCCTGCCTGTGTCCATGACCAAGACCAGCGTGGACTGCACC

ATGTACATCTGCGGCGATTCCACCGAGTGCTCCAACCTGCTGCTGCAGTACGGCAGCTTCTGCACCCAGC

TGAATAGAGCCCTGACAGGGATCGCCGTGGAACAGGACAAGAACACCCAAGAGGTGTTCGCCCAAGTGAA

GCAGATCTACAAGACCCCTCCTATCAAGGACTTCGGCGGCTTCAATTTCAGCCAGATTCTGCCCGATCCT

AGCAAGCCCAGCAAGCGGAGCTTCATCGAGGACCTGCTGTTCAACAAAGTGACACTGGCCGACGCCGGCT

TCATCAAGCAGTATGGCGATTGTCTGGGCGACATTGCCGCCAGGGATCTGATTTGCGCCCAGAAGTTTAA

CGGACTGACAGTGCTGCCTCCTCTGCTGACCGATGAGATGATCGCCCAGTACACATCTGCCCTGCTGGCC

GGCACAATCACAAGCGGCTGGACATTTGGAGCTGGCGCCGCTCTGCAGATCCCCTTTGCTATGCAGATGG

CCTACCGGTTCAACGGCATCGGAGTGACCCAGAATGTGCTGTACGAGAACCAGAAGCTGATCGCCAACCA

GTTCAACAGCGCCATCGGCAAGATCCAGGACAGCCTGAGCAGCACAGCAAGCGCCCTGGGAAAGCTGCAG

GACGTGGTCAACCAGAATGCCCAGGCACTGAACACCCTGGTCAAGCAGCTGTCCTCCAACTTCGGCGCCA

TCAGCTCTGTGCTGAACGATATCCTGAGCAGACTGGACAAGGTGGAAGCCGAGGTGCAGATCGACAGACT

GATCACCGGAAGGCTGCAGTCCCTGCAGACCTACGTTACCCAGCAGCTGATCAGAGCCGCCGAGATTAGA

GCCTCTGCCAATCTGGCCGCCACCAAGATGTCTGAGTGTGTGCTGGGCCAGAGCAAGAGAGTGGACTTTT

GCGGCAAGGGCTACCACCTGATGAGCTTCCCTCAGTCTGCCCCTCACGGCGTGGTGTTTCTGCACGTGAC

ATATGTGCCCGCTCAAGAGAAGAATTTCACCACCGCTCCAGCCATCTGCCACGACGGCAAAGCCCACTTT

CCTAGAGAAGGCGTGTTCGTGTCCAACGGCACCCATTGGTTCGTGACACAGCGGAACTTCTACGAGCCCC

AGATCATCACCACCGACAACACCTTCGTGTCTGGCAACTGCGACGTCGTGATCGGCATTGTGAACAATAC

CGTGTACGACCCTCTGCAGCCCGAGCTGGACAGCTTCAAAGAGGAACTGGACAAGTACTTTAAGAACCAC

ACAAGCCCCGACGTGGACCTGGGCGATATCAGCGGAATCAATGCCAGCGTCGTGAACATCCAGAAAGAGA

TCGACCGGCTGAACGAGGTGGCCAAGAATCTGAACGAGAGCCTGATCGACCTGCAAGAACTGGGAAAATA

CGAGCAGTACATCAAGTGGCCTTGGTACATCTGGCTGGGCTTTATCGCCGGACTGATTGCCATCGTGATG

GTCACAATCATGCTGTGTTGCATGACCAGCTGCTGTAGCTGCCTGAAGGGCTGTTGTAGCTGTGGCAGCT

GCTGCAAGTTCGACGAGGACGATTCTGAGCCCGTGCTGAAGGGCGTGAAACTGCACTACACA

>pShuttle_E1.CMVdel134TO;

SEQ ID NO: 217

TCGCGCGTTTCGGTGATGACGGTGAAAACCTCTGACACATGCAGCTCCCGGACGTCATTGTCGATGCTCT

TCAGTCCGGTGTTTATGTCACAGATCAGCTGAGCGATCGCGTTGACATTGATTATTGACTAGTTATTAAT

AGTAATCAATTACGGGGTCATTAGTTCATAGCCCATATATGGAGTTCCGCGTTACATAACTTACGGTAAA

TGGCCCGCCTGGCTGACCGCCCAACGACCCCCGCCCATTGACGTCAATAATGACGTATGTTCCCATAGTA

ACGCCAATAGGGACTTTCCATTGACGTCAATGGGTGGAGTATTTACGGTAAACTGCCCACTTGGCAGTAC

ATCAAGTGTATCATATGCCAAGTACGCCCCCTATTGACGTCAATGACGGTAAATGGCCCGCCTGGCATTA

TGCCCAGTACATGACCTTATGGGACTTTCCTACTTGGCAGTACATCTACGTATTAGTCATCGCTATTACC

ATGGTGATGCGGTTTTGGCAGTACATCAATGGGCGTGGATAGCGGTTTGACTCACGGGGATTTCCAAGTC

TCCACCCCATTGACGTCAATGGGAGTTTGTTTTGGCACCAAAATCAACGGGACTTTCCAAAATGTCGTAA

-continued

**CAACTCCGCCCCATTGACGCAAATGGGCGGTAGGCGTGTACGGTGGGAGGTCTATATAAGCAGAGCTCTC
CCTATCAGTGATAGAGATCTCCCTATCAGTGATAGAGATCGTCGACGAGCTCGTTTAGTGAACCGTCAGA
TCGCCTGGAGACGCCATCCACGCTGTTTTGACCTCCATAGAAGACACCGGGACCGATCCAGCCTCCGCGG
CCGGGAACGGTGCATTGGAA**GCTTGGTACCGGTGAATTCGCTAGCGTTAACGGATCCTCTAGACGAGATC
CGAACTTGTTTATTGCAGCTTATAATGGTTACAAATAAAGCAATAGCATCACAAATTTCACAAATAAAGC
ATTTTTTTCACTGCATTCTAGTTGTGGTTTGTCCAAACTCATCAATGTATCTTATCATGTCTGCGATCGC
AGGTAGGTTTGAGTAGTGGGCGTGGCTAAGGAAGAGCATCATTGTCACATGTGAGCAAAAGGCCAGCAAA
AGGCCAGGAACCGTAAAAAGGCCGCGTTGCTGGCGTTTTTCCATAGGCTCCGCCCCCTGACGAGCATCA
CAAAAATCGACGCTCAAGTCAGAGGTGGCGAAACCCGACAGGACTATAAAGATACCAGGCGTTTCCCCCT
GGAAGCTCCCTCGTGCGCTCTCCTGTTCCGACCCTGCCGCTTACCGGATACCTGTCCGCCTTTCTCCCTT
CGGGAAGCGTGGCGCTTTCTCATAGCTCACGCTGTAGGTATCTCAGTTCGGTGTAGGTCGTTCGCTCCAA
GCTGGGCTGTGTGCACGAACCCCCCGTTCAGCCCGACCGCTGCGCCTTATCCGGTAACTATCGTCTTGAG
TCCAACCCGGTAAGACACGACTTATCGCCACTGGCAGCAGCCACTGGTAACAGGATTAGCAGAGCGAGGT
ATGTAGGCGGTGCTACAGAGTTCTTGAAGTGGTGGCCTAACTACGGCTACACTAGAAGAACAGTATTTGG
TATCTGCGCTCTGCTGAAGCCAGTTACCTTCGGAAAAAGAGTTGGTAGCTCTTGATCCGGCAAACAAACC
ACCGCTGGTAGCGGTGGTTTTTTTGTTTGCAAGCAGCAGATTACGCGCAGAAAAAAAGGATCTCAAGAAG
ATCCTTTGATCTTTTCTACGGGGTCTGACGCTCAGTGGAACGAAAACTCACGTTAAGGGATTTTGGTCAT
GAGATTATCAAAAAGGATCTTCACCTAGATCCTTTTAAATTAAAAATGAAGTTTTAAATCAAGCCCAATC
TGAATAATGTTACAACCAATTAACCAATTCTGATTAGAAAAACTCATCGAGCATCAAATGAAACTGCAAT
TTATTCATATCAGGATTATCAATACCATATTTTTGAAAAAGCCGTTTCTGTAATGAAGGAGAAAACTCAC
CGAGGCAGTTCCATAGGATGGCAAGATCCTGGTATCGGTCTGCGATTCCGACTCGTCCAACATCAATACA
ACCTATTAATTTCCCCTCGTCAAAAATAAGGTTATCAAGTGAGAAATCACCATGAGTGACGACTGAATCC
GGTGAGAATGGCAAAAGTTTATGCATTTCTTTCCAGACTTGTTCAACAGGCCAGCCATTACGCTCGTCAT
CAAAATCACTCGCATCAACCAAACCGTTATTCATTCGTGATTGCGCCTGAGCGAGACGAAATACGCGATC
GCTGTTAAAGGACAATTACAAACAGGAATCGAATGCAACCGGCGCAGGAACACTGCCAGCGCATCAACA
ATATTTTCACCTGAATCAGGATATTCTTCTAATACCTGGAATGCTGTTTTTCCGGGGATCGCAGTGGTGA
GTAACCATGCATCATCAGGAGTACGGATAAAATGCTTGATGGTCGGAAGAGGCATAAATTCCGTCAGCCA
GTTTAGTCTGACCATCTCATCTGTAACATCATTGGCAACGCTACCTTTGCCATGTTTCAGAAACAACTCT
GGCGCATCGGGCTTCCCATACAAGCGATAGATTGTCGCACCTGATTGCCCGACATTATCGCGAGCCCATT
TATACCCATATAAATCAGCATCCATGTTGGAATTTAATCGCGGCCTCGACGTTTCCCGTTGAATATGGCT
CATAACACCCCTTGTATTACTGTTTATGTAAGCAGACAGTTTTATTGTTCATGATGATATATTTTTATCT
TGTGCAATGTAACATCAGAGATTTTGAGACACGGGCCAGAGCTGCA
Note: Bold: CMVdel134 promoter
>ID_6598_ pAd26.dE1.dE3.5orf6;
SEQ ID NO: 218
CATCATCAATAATATACCCCACAAAGTAAACAAAAGTTAATATGCAAATGAGCTTTTGAATTTTAACGGT
TTTGGGGCGGAGCCAACGCTGATTGGACGAGAAACGGTGATGCAAATGACGTCACGACGCACGGCTAACG
GTCGCCGCGGAGGCGTGGCCTAGCCCGGAAGCAAGTCGCGGGGCTGATGACGTATAAAAAAGCGGACTTT
AGACCCGGAAACGGCCGATTTTCCCGCGGCCACGCCCGGATATGAGGTAATTCTGGGCGGATGCAAGTGA
AATTAGGTCATTTTGGCGCGAAAACTGAATGAGGAAGTGAAAAGCGAAAATACCGGTCCCTCCCAGGGC
GGAATATTTACCGAGGGCCGAGAGACTTTGACCGATTACGTGGGGGTTTCGATTGCGGTGTTTTTTCGC -continued GAATTTCCGCGTCCGTGTCAAAGTCCGGTGTTTATGTCACAGATCAGCTGAgcgatcgcAGGTAGGTTTG

AGTAGTGGGCGTGGCTAAGGTGACTATAAAGGCGGGTGTCTTACGAGGGTCTTTTTGCTTTTCTGCAGAC

ATCATGAACGGGACTGGCGGGGCCTTCGAAGGGGGCTTTTTAGCCCTTATTTGACAACCCGCCTGCCGG

GATGGGCCGGAGTTCGTCAGAATGTGATGGGATCGACGGTGGATGGGCGCCCAGTGCTTCCAGCAAATTC

CTCGACCATGACCTACGCGACCGTGGGGAACTCGTCGCTCGACAGCACCGCCGCAGCCGCGGCAGCCGCA

GCCGCCATGACAGCGACGAGACTGGCCTCGAGCTACATGCCCAGCAGCGGTAGTAGCCCCTCTGTGCCCA

GTTCCATCATCGCCGAGGAGAAACTGCTGGCCCTGCTGGCCGAGCTGGAAGCCCTGAGCCGCCAGCTGGC

CGCCCTGACCCAGCAGGTGTCCGAGCTCCGCAACAGCAGCAGCAGCAAAATAAATGATTCAATAAACAC

AGATTCTGATTCAAACAGCAAAGCATCTTTATTATTTATTTTTTCGCGCGCGGTAGGCCCTGGTCCACCT

CTCCCGATCATTGAGAGTGCGGTGGATTTTTTCCAGGACCCGGTAGAGGTGGGATTGGATGTTGAGGTAC

ATGGGCATGAGCCCGTCCCGTGGGTGGAGGTAGCACCACTGCATGGCCTCGTGCTCTGGGGTCGTGTTGT

AGATGATCCAGTCATAGCAGGGGCGCTGGGCGTGGTGCTGGATGATGTCCTTGAGGAGGAGACTGATGGC

CACGGGGAGCCCCTTGGTGTAGGTGTTGGCAAAACGGTTGAGCTGGGAGGGATGCATGCGGGGGGAGATG

ATGTGCAGTTTGGCCTGGATCTTGAGGTTGGCGATGTTGCCACCCAGATCCCGCCGGGGGTTCATGTTGT

GCAGGACCACCAGAACGGTGTAGCCCGTGCACTTGGGGAACTTGTCATGCAACTTGGAAGGGAATGCGTG

GAAGAATTTGGAGACGCCCTTGTGCCCGCCCAGGTTTTCCATGCACTCATCCATGATGATGGCAATGGGC

CCGTGGGCTGCGGCTTTGGCAAAGACGTTTCTGGGGTCAGAGACATCGTAATTATGCTCCTGGGTGAGAT

CATCATAAGACATTTTAATGAATTTGGGCGGAGGGTGCCAGATTGGGGACGATGGTTCCCTCGGGCCC

CGGGGCGAAGTTCCCCTCGCAGATCTGCATCTCCCAGGCTTTCATCTCGGAGGGGGGATCATGTCCACC

TGCGGGGCGATGAAAAAAACGGTTTCCGGGGCGGGGGTGATGAGCTGCGAGGAGAGCAGGTTTCTCAACA

GCTGGGACTTGCCGCACCCGGTCGGGCCGTAGATGACCCCGATGACGGGTTGCAGGTGGTAGTTCAAGGA

CATGCAGCTGCCGTCGTCCCGGAGGAGGGGGGCCACCTCGTTGAGCTTGTCTCTGACTTGGAGGTTTTCC

CGGACGAGCTCGCCGAGGAGGCGGTCCCCGCCCAGCGAGAGAAGCTCTTGCAGGGAAGCAAAGTTTTTCA

GGGGCTTGAGCCCGTCGGCCATGGGCATCTTGGCGAGGGTCTGCGAGAGGAGCTCCAGGCGGTCCCAGAG

CTCGGTGACGTGCTCTACGGCATCTCGATCCAGCAGACTTCCTCGTTTCGGGGGTTGGGACGACTGCGAC

TGTAGGGCACGAGACGATGGGCGTCCAGCGCGGCCAGCGTCATGTCCTTCCAGGGTCTCAGGGTCCGCGT

GAGGGTGGTCTCCGTCACGGTGAAGGGGTGGGCCGCGGGCTGGGCGCTTGCAAGGGTGCGCTTGAGACTC

ATCCTGCTGGTGCTGAAACGGGCACGGTCTTCGCCCTGCGCGTCGGCGAGATAGCAGTTGACCATGAGCT

CGTAGTTGAGGGCCTCGGCGGCGTGGCCCTTGGCGCGGAGCTTGCCCTTGGAAGAGCGCCCGCAGGCGGG

ACAGAGGAGGGATTGCAGGGCGTAGAGCTTGGGCGCGAGAAAGACGGACTCGGGGGCGAAGGCGTCCGCT

CCGCAGTGGGCGCAGACGGTCTCGCACTCGACTAGCCAGGTGAGCTCGGGCTGCTCGGGGTCAAAAACCA

GTTTTCCCCCGTTCTTTTTGATGCGCTTCTTACCTCGCGTCTCCATGAGTCTGTGTCCGCGCTCGGTGAC

AAACAGGCTGTCTGTGTCCCCGTAGACGGACTTGATGGGCCTGTCCTGCAGGGGCGTCCCGCGGTCCTCC

TCGTAGAGAAACTCAGACCACTCTGAGACGAAGGCGCGCGTCCACGCCAAGACAAAGGAGGCCACGTGCG

AGGGGTAGCGGTCGTTGTCCACCAGGGGGTCCACCTTTTCCACGGTATGCAGGCACATGTCCCCCTCCTC

CGCATCCAAGAAGGTGATTGGCTTGTAGGTGTAGGCCACGTGACCTGGGGTTCCCGACGGGGGGTATAA

AAGGGGGCGGGTCTGTGCTCGTCCTCACTCTCTTCCGCGTCGCTGTCCACGAGCGCCAGCTGTTGGGGTA

GGTATTCCCTCTCAAGAGCGGGCATGACCTCGGCACTCAGGTTGTCAGTTTCTAGAAACGAGGAGGATTT

GATGTGGGCCTGCCCTGCCGCGATGCTTTTTAGGAGACTTTCATCCATCTGGTCAGAAAAGACTATTTTT

TTATTGTCAAGCTTGGTGGCGAAGGAGCCATAGAGGGCGTTTGAGAGAAGCTTGGCGATGGATCTCATGG

TCTGATTTTTGTCACGGTCGGCGCGCTCCTTGGCCGCGATGTTGAGCTGGACATATTCGCGCGCGACACA

-continued

```
CTTCCATTCGGGGAAGACGGTGGTGCGCTCGTCGGGCACGATCCTGACGCGCCAGCCGCGGTTATGCAGG

GTGACCAGGTCCACGCTGGTGGCCACCTCGCCGCGCAGGGGCTCGTTGGTCCAGCAGAGTCTGCCGCCCT

TGCGCGAGCAGAACGGGGGCAGCACATCAAGCAGATGCTCGTCAGGGGGGTCCGCATCGATGGTGAAGAT

GCCCGGACAGAGTTCCTTGTCAAAATAATCGATTTTTGAGGATGCATCGTCCAAGGCCATCTGCCACTCG

CGGGCGGCCAGCGCTCGCTCGTAGGGGTTGAGGGGCGGACCCCAAGGCATGGGATGCGTGAGGGCGGAGG

CGTACATGCCGCAGATGTCATAGACATAGATGGGCTCCGAGAGGATGCCGATGTAGGTGGGATAGCAGCG

CCCCCCGCGGATGCTTGCGCGCACGTAGTCATACAACTCGTGCGAGGGGGCCAAGAAGGCGGGGCCGAGA

TTGGTGCGCTGGGGCTGCTCGGCGCGGAAGACGATCTGGCGAAAGATGGCGTGCGAGTTGGAGGAGATGG

TGGGCCGTTGGAAGATGTTAAAGTGGGCGTGAGGCAGGCGGACCGAGTCGCGGATGAAGTGCGCGTAGGA

GTCTTGCAGCTTGGCGACGAGCTCGGCGGTGACGAGGACGTCCATGGCGCAGTAGTCCAGCGTTTCGCGG

ATGATGTCATAACTCGCCTCTCCTTTCTTCTCCCACAGCTCGCGGTTGAGGGCGTATTCCTCGTCATCCT

TCCAGTACTCCCGGAGCGGGAATCCTCGATCGTCCGCACGGTAAGAGCCCAGCATGTAGAAATGGTTCAC

GGCCTTGTAGGGACAGCAGCCCTTCTCCACGGGGAGGGCGTAAGCTTGAGCGGCCTTGCGGAGCGAGGTG

TGCGTCAGGGCAAAGGTGTCCCTGACCATGACTTTCAAGAACTGGTACTTGAAGTCCGAGTCGTCGCAGC

CGCCGTGCTCCCAGAGCTCGAAATCGGTGCGCTTCTTCGAGAGGGGGTTAGGCAGAGCGAAAGTGACGTC

ATTGAAGAGAATCTTGCCTGCCCGCGCATGAAATTGCGGGTGATGCGGAAAGGGCCCGGGACGGAGGCT

CGGTTGTTGATGACCTGGGCGGCGAGGACGATCTCGTCAAAGCCGTTGATGTTGTGCCCGACGATGTAGA

GTTCCATGAATCGCGGGCGGCCTTTGATGTGCGGCAGCTTTTTGAGCTCCTCGTAGGTGAGGTCCTCGGG

GCATTGCAGGCCGTGCTGCTCGAGCGCCCACTCCTGGAGATGTGGGTTGGCTTGCATGAAGGAAGCCCAG

AGCTCGCGGGCCATGAGGGTCTGGAGCTCGTCGCGAAAGAGGCGGAACTGCTGGCCCACGGCCATCTTTT

CTGGGGTGACGCAGTAGAAGGTGAGGGGGTCCCGCTCCCAGCGATCCCAGCGTAAACGCACGGCGAGATC

GCGAGCGAGGGCGACCAGCTCTGGGTCCCCGGAGAATTTCATGACCAGCATGAAGGGGACGAGCTGCTTG

CCGAAGGACCCCATCCAGGTGTAGGTTTCTACATCGTAGGTGACAAAGAGCCGCTCCGTGCGAGGATGAG

AGCCGATTGGGAAGAACTGGATTTCCTGCCACCAGTTGGACGAGTGGCTGTTGATGTGATGAAAGTAGAA

ATCCCGCCGGCGAACCGAGCACTCGTGCTGATGCTTGTAAAAGCGTCCGCAGTACTCGCAGCGCTGCACG

GGCTGTACCTCATCCACGAGATACACAGCGCGTCCCTTGAGGAGGAACTTCAGGAGTGGCGGCCCTGGCT

GGTGGTTTTCATGTTCGCCTGCGTGGGACTCACCCTGGGGCTCCTCGAGGACGGAGAGGCTGACGAGCCC

GCGCGGGAGCCAGGTCCAGATCTCGGCGCGGCGGGGCGGAGAGCGAAGACGAGGGCGCGCAGTTGGGAG

CTGTCCATGGTGTCGCGGAGATCCAGGTCCGGGGCAGGGTTCTGAGGTTGACCTCGTAGAGGCGGGTGA

GGGCGTGCTTGAGATGCAGATGGTACTTGATTTCTACGGGTGAGTTGGTGGTCGTGTCCACGCATTGCAT

GAGCCCGTAGCTGCGCGGGCCACGACCGTGCCGCGGTGCGCTTTTAGAAGCGGTGTCGCGGACGCGCTC

CCGGCGGCAGCGGCGGTTCCGGCCCCGCGGGCAGGGGCGGCAGAGGCACGTCGGCGTGGCGCTCGGGCAG

GTCCCGGTGCTGCGCCCTGAGAGCGCTGGCGTGCGCGACGACGCGGCGGTTGACATCCTGGATCTGCCGC

CTCTGCGTGAAGACCACGGGCCCCGTGACTTTGAACCTGAAAGACAGTTCAACAGAATCAATCTCTGCGT

CATTGACGGCGCCTGACGCAGGATCTCTTGCACGTCGCCCGAGTTGTCCTGGTAGGCGATCTCGGACAT

GAACTGTTCGATCTCCTCCTCCTGGAGATCGCCGCGGCCCGCGCGCTCCACGGTGGCGGCGAGGTCATTG

GAGATGCGACCCATGAGCTGCGAGAAGGCGCCCAGGCCGCTCTCGTTCCAGACGCGGCTGTAGACCACGT

CCCCGTCGGCGTCGCGCGCGCGCATGACCACCTGCGCGAGGTTGAGCTCCACGTGCCGCGCAAAGACGGC

GTAGTTGCGCAGGCGCTGGAAGAGGTAGTTGAGGGTGGTGGCGATGTGCTCGGTGACGAAGAAGTACATG

ATCCAGCGGCGCAGGGGCATCTCGCTGATGTCGCCGATGGCTTCCAGCCTTTCCATGGCCTCGTAGAAGT
```

```
CCACGGCGAAGTTGAAAAACTGGGCGTTGCGGGCCGAGACCGTGAGCTCGTCTTCCAGGAGCCGGATGAG

TTCGGCGATGGTGGCGCGCACCTCGCGCTCGAAATCCCCGGGGGCCTCCTCCTCTTCCTCTTCTTCCATG

ACGACCTCTTCTTCTATTTCTTCCTCTGGGGCGGTGGTGGTGGCGGGGGCCGACGACGACGGCGACGCA

CCGGGAGACGGTCGACGAAGCGCTCGATCATCTCCCCGCGGCGGCGACGCATGGTTTCGGTGACGGCGCG

ACCCCGTTCGCGAGGACGCAGCGTGAAGACGCCGCCGGTCATCTCCCGGTAATGGGGCGGGTCCCCATTG

GGCAGCGATAGGGCGCTGACGATGCATCTTATCAATTGCGGTGTAGGGGACGTGAGCGCGTCGAGATCGA

CCGGATCGGAGAATCTTTCGAGGAAAGCGTCTAGCCAATCGCAGTCGCAAGGTAAGCTCAAACACGTAGC

AGCCCTGCGGACGCTGTTAGAATTGCGGTTGCTGATGATGTAATTGAAGTAGGCGTTTTTGAGGCGGCGG

ATGGTGGCGAGGAGGACCAGGTCCTTGGGTCCAGCTTGCTGGATGCGGAGCCGCTCGGCCATGCCCCAGG

CCTGGCCCTGACACCGGCTCAGGTTCTTGTAGTAGTCATGCATGAGCCTCTCAATGTCATCACTGGCTGA

GGCGGAGTCTTCCATGCGGGTGACCCCGACGCCCCTGAGCGGCTGCACGAGCGCCAGGTCGGCGACGACG

CGCTCGGCGAGGATGGCCTGTTGCACGCGGGTGAGGGTGTCCTGGAAGTCGTCCATGTCGACGAAGCGGT

GATAGGCCCCGGTGTTGATGGTGTAGGTGCAGTTGGCCATGAGCGACCAGTTGACGGTCTGCAGGCCTGG

CTGCACGACCTCGGAGTACCTGAGCCGCGAGAAGGCGCGCGAGTCGAAGACGTAGTCGTTGCAGGTGCGC

ACGAGGTACTGGTATCCGACTAGGAAGTGCGGCGGCGGCTGGCGGTAGAGCGGCCAGCGCTGGGTGGCCG

GCGCGCCCGGGGCCAGGTCCTCGAGCATGAGGCGGTGGTAGCCGTAGAGGTAGCGGGACATCCAGGTGAT

GCCGGCGGCGGTGGTGGAGGCGCGCGGGAACTCGCGGACGCGGTTCCAGATGTTGCGCAGCGGCAGGAAA

TAGTCCATGGTCGGCACGGTCTGGCCGGTGAGACGCGCGCAGTCATTGACGCTCTAGAGGCAAAAACGAA

AGCGGTTGAGCGGGCTCTTCCTCCGTAGCCTGGCGGAACGCAAACGGGTTAGGCCGCGTGTGTACCCCGG

TTCGAGTCCCCTCGAATCAGGCTGGAGCCGCGACTAACGTGGTATTGGCACTCCCGTCTCGACCCGAGCC

CGATAGCCGCCAGGATACGGCGGAGAGCCCTTTTTGCCGGCCGAGTGGGGTCGCTAGACTTGAAAGCGAC

CGAAAACCCtGCCGGGTAGTGGCTCGCGCCCGTAGTCTGGAGAAGCATCGCCAGGGTTGAGTCGCGGCAG

AACCCGGTTCGAGGACGGCCGCGGCGAGCGGGACTTGGTCACCCCGCCGATATAAAGACCCACAGCCAGC

CGACTTCTCCAGTTACGGGAGCGAGCCCCCTTTTTTCTTTTTGCCAGATGCATCCCGTCCTGCGCCAAAT

GCGTCCCACCCCCCCGGCGACCACCGCGACCGCGGCCGTAGCAGGCGCCGGCGCTAGCCAGCCACCACAG

ACAGAGATGGACTTGGAAGAGGGCGAAGGGCTGGCAAGACTGGGGGCGCCGTCCCCGGAGCGACATCCCC

GCGTGCAGCTGCAGAAGGACGTGCGCCCGGCGTACGTGCCTACGCAGAACCTGTTCAGGGACCGCAGCGG

GGAGGAGCCCGAGGAGATGCGCGACTGCCGGTTTCGGGCGGGCAGGGAGCTGCGCGAGGGCCTGGACCGC

CAGCGCGTGCTGCGCGACGAGGATTTCGAGCCGAACGAGCAGACGGGGATCAGCCCCGCACGCGCGCACG

TGGCGGCAGCCAACCTGGTGACGGCCTACGAGCAGACGGTGAAGCAGGAGCGCAACTTCCAAAAGAGTTT

CAACAACCACGTGCGCACCCTGATCGCGCGCGAGGAGGTGGCCCTGGGCCTGATGCACCTGTGGGACCTG

GCGGAGGCCATCGTGCAGAACCCGGACAGCAAGCCTCTGACGGCGCAGCTGTTCCTGGTGGTGCAGCACA

GCAGGGACAACGAGGCGTTCAGGGAGGCGCTGCTGAACATCGCCGAGCCCGAGGGTCGCTGGCTGCTGGA

GCTGATTAACATCTTGCAGAGCATCGTAGTGCAGGAGCGCAGCCTGAGCCTGGCCGAGAAGGTGGCGGCG

ATCAACTACTCGGTGCTGAGCCTGGGCAAGTTTTACGCGCGCAAGATTTACAAGACGCCGTACGTGCCCA

TAGACAAGGAGGTGAAGATAGACAGCTTTTACATGCGCATGGCGCTCAAGGTGCTGACGCTGAGCGACGA

CCTgGGCGTGTACCGCAACGACCGCATCCACAAGGCCGTGAGCACGAGCCGGCGGCGCGAGCTGAGCGAC

CGCGAGCTGATGCTGAGTCTGCGCCGGGCGCTGGTAGGGGGCGCCGCCGGCGGCGAGGAGTCCTACTTCG

ACATGGGTGCGGACCTGCATTGGCAGCCGAGCCGGCGCGCCTTGGAGGCCGCCTACGGTTCAGAGGACTT

GGATGAGGAAGAGGAAGAGGAGGAGGATGCACCCGCTGCGGGGTACTGACGCCTCCGTGATGTGTTTTTA

GATGTCCCAGCAAGCCCCGGACCCCGCCATAAGGGCGGCGCTGCAAAGCCAGCCGTCCGGTCTAGCATCG
```

-continued

```
GACGACTGGGAGGCCGCGATGCAACGCATCATGGCCCTGACGACCCGCAACCCCGAGTCCTTTAGACAAC

AGCCGCAGGCCAACAGACTCTCGGCCATTCTGGAGGCGGTGGTCCCCTCTCGGACCAACCCCACGCACGA

GAAGGTGCTGGCGATCGTGAACGCGCTGGCGGAGAACAAGGCCATCCGTCCCGACGAGGCCGGGCTGGTG

TACAACGCCCTGCTGGAGCGCGTGGGCCGCTACAACAGCACGAACGTGCAGTCCAACCTGGATCGGCTGG

TGACGGACGTGCGCGAGGCCGTGGCGCAGCGCGAGCGGTTCAAGAACGAGGGCCTGGGCTCGCTGGTGGC

GCTGAACGCCTTCCTGGCgACGCAGCCGGCGAACGTGCCGCGCGGGCAGGACGATTACACCAACTTTATC

AGCGCGCTGCGGCTGATGGTGACCGAGGTGCCCCAGAGCGAGGTGTACCAGTCTGGCCCGGACTACTTTT

TCCAGACGAGCCGGCAGGGCTTGCAGACGGTGAACCTGAGCCAGGCTTTCAAGAATCTGCGCGGGCTGTG

GGGCGTGCAGGCGCCCGTGGGCGACCGGTCAACGGTGAGCAGCTTGCTGACGCCCAACTCGCGGCTGCTG

CTGCTGCTGATCGCGCCCTTCACCGACAGCGGCAGCGTGAACCGCAACTCGTACCTGGGCCATCTGCTGA

CGCTGTACCGCGAGGCCATAGGCCAGGCGCAGGTGGACGAGCAGACCTTCCAGGAGATCACTAGCGTGAG

CCGCGCGCTGGGGCAGAACGACACCGACAGTCTGAGGGCCACCCTGAACTTTTTGCTGACCAATAGACAG

CAGAAGATCCCGGCGCAGTACGCACTGTCGGCCGAGGAGGAAAGGATTCTGAGATATGTGCAGCAGAGCG

TAGGGCTGTTCCTGATGCAGGAGGGTGCCACCCCCAGCGCCGCGCTGGACATGACCGCGCGCAACATGGA

ACCTAGCATGTACGCCGCCAACCGGCCGTTCATCAATAAGCTGATGGACTACTTGCACCGCGCGGCGGCC

ATGAACACGGACTACTTTACCAACGCCATCCTGAACCCGCACTGGCTCCCGCCGCCGGGGTTCTACACGG

GCGAGTACGACATGCCCGACCCCAACGACGGGTTCCTGTGGGACGACGTGGACAGCGCGGTGTTCTCGCC

GACCTTTCAAAAGCGCCAGGAGGCGCCGCCGAGCGAGGGCGCGGTGGGGAGGAGCCCCTTTCCTAGCTTA

GGGAGTTTGCATAGCTTGCCGGGCTCGGTGAACAGCGGCAGGGTGAGCCGGCCGCGCTTGCTGGGCGAGG

ACGAGTACCTGAACGACTCGCTGCTGCAGCCGCCGCGGGCCAAGAACGCCATGGCCAATAACGGGATAGA

GAGTCTGGTGGACAAACTGAACCGCTGGAAGACCTACGCTCAGGACCATAGGGACGCGCCCGCGCCGCGG

CGACAGCGCCACGACCGGCAGCGGGGCCTGGTGTGGGACGACGAGGACTCGGCCGACGATAGCAGCGTGT

TGGACTTGGGCGGGAGCGGTGGGGTCAACCCGTTCGCGCATCTGCAGCCCAAACTGGGGCGACGGATGTT

TTGAATGAAATAAAACTCACCAAGGCCATAGCGTGCGTTCTCTTCCTTGTTAGAGATGAGGCGCGCGGTG

GTGTCTTCCTCTCCTCCTCCCTCGTACGAGAGCGTGATGGCGCAGGCGACCCTGGAGGTTCCGTTTGTGC

CTCCGCGGTATATGGCTCCTACGGAGGGCAGAAACAGCATTCGTTACTCGGAGCTGGCTCCGCAGTACGA

CACCCACTCGCGTGTACTTGGTGGACAACAAGTCGGCGGACATCGCTTCCCTGAACTACCAAAACGACCAC

AGCAACTTCCTGACCACGGTGGTGCAGAACAACGATTTCACCCCCGCCGAGGCCAGCACGCAGACGATAA

ATTTTGACGAGCGGTCGCGGTGGGGCGGTGATCTGAAGACCATTCTGCACACTAACATGCCCAATGTGAA

CGAGTACATGTTCACCAGCAAGTTTAAGGCGCGGGTGATGGTGTCTAGGAAGCATCCAGAGGGGGTAGTT

GAAACAGATTTGAGTCAGGATAAGCTTGAATATGAGTGGTTTGAGTTTACCCTGCCCGAGGGAAACTTTT

CCGAGACCATGACCATAGACCTGATGAACAACGCCATCTTGGAAAACTACTTGCAAGTGGGGCGGCAGAA

TGGCGTGCTGGAGAGCGATATCGGAGTCAAGTTTGACAGCAGAAATTTCAAGCTGGGCTGGGACCCGGTG

ACCAAGCTGGTGATGCCAGGGGTCTACACCTACGAGGCCTTCCACCCGGACGTGGTGCTGCTGCCGGGCT

GCGGGGTGGACTTCACCGAGAGCCGCCTGAGCAACCTCCTGGGCATTCGCAAGAAGCAACCTTTCCAAGA

GGGCTTCAGAATCATGTATGAGGATCTAGAAGGTGGCAACATCCCCGCCCTCCTTGATGTGCCCAAGTAC

TTGGAAAGCAAGAAGAAAGTTGAAGACGAAACTAAAAATGCAGCTGCGGCCACAGCCGATACAACCACTA

GGGGTGATACATTTGCAACTCCAGCGCAAGAGACAGCAGCTGATAAGAAGGTAGAAGTCTTGCCCATTGA

AAAGGATGAGAGTGGTAGAAGTTACAACCTGATCCAGGGGACCCACGACACGCTGTACCGCAGTTGGTAC

CTGTCCTATACCTACGGGGACCCCGAGAAGGGGGTGCAGTCGTGGACGCTGCTCACCACCCCGGACGTTA
```

```
CCTGCGGCGCGGAGCAAGTCTACTGGTCACTGCCGGACCTCATGCAAGACCCCGTCACCTTCCGCTCCAC
CCAGCAAGTCAGCAACTACCCCGTGGTCGGCGCCGAGCTCATGCCCTTCCGCGCCAAGAGCTTTTACAAC
GACCTCGCCGTCTACTCCCAGCTCATCCGCAGCTACACCTCCCTCACCCACGTCTTCAACCGCTTCCCCG
ACAACCAGATCCTCTGCCGCCCGCCCGCGCCCACCATCACCACCGTCAGTGAAAACGTGCCTGCTCTCAC
AGATCACGGGACGCTACCGCTGCGCAGCAGTATCCGCGGAGTCCAGCGAGTGACCGTCACTGACGCCCGT
CGCCGCACCTGTCCCTACGTCTACAAGGCCCTGGGCATAGTCGCGCCGCGCGTGCTTTCCAGTCGCACCT
TCTAAAAAATGTCTATTCTCATCTCGCCCAGCAATAACACCGGCTGGGGTCTTACTAGACCCAGCACCA
TGTACGAGGAGCCAAGAAGCGCTCCCAGCAGCACCCCGTCCGCGTCCGCGGCCACTTCCGCGCTCCCTG
GGGCGCaTACAAGCGCGGGCGGACTTCCACCGCCGCCGTGCGCACCACCGTCGACGACGTCATCGACTCG
GTGGTCGCCGACGCGCGCAACTAtACcCCCGCCCCCTCCACCGTGGACGCGGTCATCGACAGCGTGGTGG
CCGACGCGCGCGACTATGCCAGACGCAAGAGCCGGCGGCGACGGATCGCCAGGCGCCACCGGAGCACGCC
CGCCATGCGCGCCGCCCGGGCTCTGCTGCGCCGCGCCAGACGCACGGGCCGCCGGGCCATGATGCGAGCC
GCGCGCCGCGCTGCCACTGCACCCACCCCCGCAGGCAGGACTCGCAGACGAGCGGCCGCCGCCGCCGCTG
CGGCCATCTCTAGCATGACCAGACCCAGGCGCGGAAACGTGTACTGGGTGCGCGACTCCGTCACGGGCGT
GCGCGTGCCCGTGCGCACCCGTCCTCCTCGTCCCTGATCTAATGCTTGTGTCCTCCCCCGCAAGCGACGA
TGTCAAAGCGCAAAATCAAGGAGGAGATGCTCCAGGTCGTCGCCCCGGAGATTTACGGACCACCCCAGGC
GGACCAGAAACCCCGCAAAATCAAGCGGGTTAAAAAAAAGGATGAGGTGGACGAGGGGGCAGTAGAGTTT
GTGCGCGAGTTCGCTCCGCGGCGGCGCGTAAATTGGAAGGGGCGCAGGGTGCAGCGCGTGTTGCGGCCCG
GCACGGCGGTGGTGTTCACGCCCGGCGAGCGGTCCTCGGTCAGGAGCAAGCGTAGCTATGACGAGGTGTA
CGGCGACGACGACATCCTGGACCAGGCGGCGGAGCGGGCGGGCGAGTTCGCCTACGGGAAGCGGTCGCGC
GAAGAGGAGCTGATCTCGCTGCCGCTGGACGAAAGCAACCCCACGCCGAGCCTGAAGCCCGTGACCCTGC
AGCAGGTGCTGCCCCAGGCGGTGCTGCTGCCGAGCCGCGGGGTCAAGCGCGAGGGCGAGAGCATGTACCC
GACCATGCAGATCATGGTGCCCAAGCGCCGGCGCGTGGAGGACGTGCTGGACACCGTGAAAATGGATGTG
GAGCCCGAGGTCAAGGTGCGCCCCATCAAGCAGGTGGCGCCGGGCCTGGGCGTGCAAACCGTGGACATTC
AGATCCCCACCGACATGGATGTCGACAAAAAACCCTCGACCAGCATCGAGGTGCAAACCGACCCCTGGCT
CCCAGCCTCCACCGCTACCGTCTCCACTTCTACCGCCGCCACGGCTACCGAGCCTCCCAGGAGGCGAAGA
TGGGGCGCCGCCAGCCGGCTGATGCCCAACTACGTGTTGCATCCTTCCATCATCCCGACGCCGGGCTACC
GCGGCACCCGGTACTACGCCAGCCGCCGGCGCCCAGCCAGCAAACGCCGCCGCCGCACCGCCACCCGCCG
CCGTCTGGCCCCCGCCCGCGTGCGCCGCGTGACCACGCGCCGGGGCCGCTCGCTCGTTCTGCCCACCGTG
CGCTACCACCCCAGCATCCTTTAATcCGTGTGCTGTGATACTGTTGCAGAGAGATGGCTCTCACTTGCCG
CCTGCGCATCCCCGTCCCGAATTACCGAGGAAGATCCCGCCGCAGGAGAGGCATGGCAGGCAGCGGCCTG
AACCGCCGCCGGCGGCGGGCCATGCGCAGGCGCCTGAGTGGCGGCTTTCTGCCCGCGCTCATCCCCATAA
TCGCCGCGGCCATtGGCACGATCCCGGGCATAGCTTCCGTTGCGCTGCAGGCGTCGCAGCGCCGTTGATG
TGCGAATAAAGCCTCTTTAGACTCTGACACACCTGGTCCTGTATATTTTTAGAATGGAAGACATCAATTT
TGCGTCCCTGGCTCCGCGGCACGGCACGCGGCCGTTCATGGGCACCTGGAACGAGATCGGCACCAGCCAG
CTGAACGGGGCGCCTTCAATTGGAGCAGTGTCTGGAGCGGGCTTAAAAATTTCGGCTCGACGCTCCGGA
CCTATGGGAACAAGGCCTGGAATAGTAGCACGGGGCAGTTGTTGAGGGAAAAGCTCAAAGACCAgAACTT
CCAGCAGAAGGTGGTGGACGGGCTGGCCTCGGGCATTAACGGGGTGGTGGACATCGCGAACCAGGCCGTG
CAGCGCGAGATAAACAGCCGCCTGGACCCGCGACCGCCCACGGTGGTGGAGATGGAAGATGCAACTCTTC
CGCCGCCCAAgGGCGAgAAGCGGCCGCGGCCCGACGCGGAGGAGACGATCCTGCAGGTGGACGAGCCGCC
CTCGTACGAGGAGGCCGTCAAGGCCGGCATGCCCACCACGCGCATCATCGCGCCGCTGGCCACGGGTGTA
```

-continued

```
ATGAAACCCGCCACCCTTGACCTGCCTCCACCACCCGCGCCCGCTCCACCGAAGGCAACTCCGGTTGTGC

AGGCCCCCCGGTGGCGACCGCCGTGCGCCGCGTCCCCGCCCGCCGCCAGGCCCAGAACTGGCAGAGCAC

GCTGCACAGTATCGTGGGCCTGGGAGTGAAAAGTCTGAAGCGCCGCCGATGCTATTGAGAGAGAGGAAAG

AGGACACTAAAGGGAGAGCTTAACTTGTATGTGCCTTACCGCCAGAGAACGCGCGAAGATGGCCACCCCC

TCGATGATGCCGCAGTGGGCGTACATGCACATCGCCGGGCAGGACGCCTCGGAGTACCTGAGCCCGGGTC

TGGTGCAGTTTGCCCGCGCCACCGACACGTACTTCAGCCTGGGCAACAAGTTTAGGAACCCCACGGTGGC

CCCGACCCACGATGTGACCACGGACCGGTCCCAGCGTCTGACGCTGCGCTTCGTGCCCGTGGATCGCGAG

GACACCACGTACTCGTACAAGGCGCGCTTCACTCTGGCCGTGGGCGACAACCGGGTGCTAGACATGGCCA

GCACTTACTTTGACATCCGCGGCGTCCTGGACCGCGGTCCCAGCTTCAAACCCTACTCGGGCACGGCCTA

CAACAGCCTGGCTCCCAAGGGTGCCCCCAATCCCAGTCAGTGGGAAACAAAAGAAAAGCAAGGAACTACT

GGAGGAGTGCAGCAAGAAAAAGATGTCACAAAAACATTTGGTGTGGCTGCCACCGGCGGAATTAATATAA

CAAACCAGGGTCTGTTACTAGGAACTGACGAAACCGCTGAGAATGGCAAAAAAGACATTTATGCAGACAA

GACTTTCCAGCCAGAACCTCAAGTTGGAGAAGAAAACTGGCAGGAAAATGAAGCCTTCTATGGAGGAAGG

GCTCTTAAAAAGGACACTAAAATGAAACCATGCTATGGATCTTTTGCTAGACCTACTAATGAGAAAGGAG

GTCAGGCAAAGTTCAAACCAGTTAATGAAGGAGAACAACCTAAAGATCTGGATATAGATTTTGCTTACTT

TGACGTCCCTGGCGGAAGTCCTCCAGCAGGTGGTAGTGGGGAAGAATACAAAGCAGATATAATTTTGTAC

ACTGAAAATGTTAATCTTGAAACACCAGACACTCATGTGGTTTACAAGCCAGGAACTTCAGATAACAGTT

CAGAAATCAATCTGGTTCAGCAGTCCATGCCAAACAGACCCAACTACATTGGCTTTAGGGACAACTTTGT

AGGTCTCATGTATTACAACAGCACCGGAAATATGGGTGTGCTGGCTGGTCAGGCTTCTCAGTTGAACGCT

GTGGTCGACTTGCAAGACAGAAACACCGAGTTATCTTACCAGCTATTGCTAGATTCTCTGGGTGACAGAA

CCAGATACTTTAGCATGTGGAACTCTGCGGTGGACAGTTACGATCCAGATGTCAGGATCATTGAAAATCA

CGGTGTGGAAGATGAACTTCCAAACTATTGCTTCCCATTGAATGGCACTGGAACCAATTCCACTTATCAA

GGTGTAAAGATTACAAATGGTAATGATGGTGCTGAAGAAAGTGAGTGGGAGAAAGACGATGCAATTTCTA

GACAAAACCAAATCTGCAAGGGCAATGTCTACGCCATGGAGATCAACCTGCAGGCCAACCTGTGGAAGAG

TTTTCTGTACTCGAACGTGGCCCTGTACCTGCCCGACTCCTACAAGTACACGCCGGCCAACGTCAAGCTG

CCCGCCAACACCAACACCTACGAGTACATGAACGGCCGCGTGGTAGCCCCcTCgCTGGTGGACGCCTACA

TCAACATCGGCGCCCGCTGGTCGTTGGACCCCATGGACAACGTCAACCCCTTCAACCACCACCGCAATGC

GGGCCTGCGCTACCGCTCCATGCTGCTGGGCAACGGCCGCTACGTGCCCTTCCACATCCAAGTGCCCCAA

AAGTTCTTTGCCATCAAGAACCTGCTCCTGCTCCCGGGCTCCTACACCTACGAGTGGAACTTCCGCAAGG

ACGTCAACATGATCCTGCAGAGTTCCCTCGGCAACGACCTGCGCGTCGACGGCGCCTCCGTCCGCTTCGA

CAGCGTCAACCTATACGCCACTTTCTTCCCCATGGCGCACAACACCGCTTCAACCTTGGAAGCCATGCTG

CGCAACGACACCAACGACCAGTCCTTCAACGACTACCTCTCGGCCGCCAACATGCTCTACCCCATCCCGG

CCAAGGCCACCAACGTGCCCATCTCCATCCCATCGCGCAACTGGGCCGCCTTCCGCGGCTGGAGTTTCAC

CCGGCTCAAGACCAAGGAAACTCCTTCCCTCGGCTCGGGTTTCGACCCCTACTTTGTCTACTCGGGCTCC

ATCCCCTACCTCGACGGGACCTTCTACCTCAACCACACCTTCAAGAAGGTCTCCATCATGTTCGACTCCT

CGGTCAGCTGGCCCGGCAACGACCGGCTGCTCACGCCGAACGAGTTCGAGATCAAGCGCAGCGTCGACGG

GGAGGGCTACAACGTGGCCCAATGCAACATGACCAAGGACTGGTTCCTCGTCCAGATGCTCTCCCACTAC

AACATCGGCTACCAGGGCTTCCACGTGCCCGAGGGCTACAAGGACCGCATGTACTCCTTCTTCCGCAACT

TCCAGCCCATGAGCAGGCAGGTGGTCGATGAGATCAACTACAAGGACTACAAGGCCGTCACCCTGCCCTT

CCAGCACAATAACTCGGGCTTCACCGGCTACCTCGCACCCACCATGCGCCAGGGGCAGCCCTACCCCGCC
```

-continued

```
AACTTCCCCTACCCGCTCATCGGTCAGACAGCCGTGCCCTCCGTCACCCAGAAAAAGTTCCTCTGCGACA
GGGTCATGTGGCGCATCCCcTTCTCCAGCAACTTCATGTCCATGGGCGCCCTCACCGACCTGGGTCAGAA
CATGCTCTACGCCAACTCGGCCCACGCGCTCGACATGACCTTCGAGGTGGACCCCATGGATGAGCCCACC
CTCCTCTATCTTCTCTTCGAAGTTTTCGACGTGGTCAGAGTACACCAGCCGCACCGCGGCGTCATCGAGG
CCGTCTACCTGCGCACGCCCTTCTCCGCCGGCAACGCCACCACCTAAGCATGAGCGGCTCCAGCGAACGA
GAGCTCGCGGCCATCGTGCGCGACCTGGGCTGCGGGCCCTACTTTTTGGGCACCCACGACAAGCGCTTCC
CGGGCTTTCTCGCCGGCGACAAGCTGGCCTGCGCCATCGTCAACACGGCCGGCCGCGAGACCGGAGGCGT
GCACTGGCTCGCCTTCGGCTGGAACCCGCGCTCGCGCACCTGCTACATGTTCGACCCCTTTGGGTTCTCG
GACCGCCGGCTCAAGCAGATTTACAGCTTCGAGTACGAGGCCATGCTGCGCCGCAGCGCCCTGGCCTCCT
CGCCCGACCGCTGTCTCAGCCTCGAGCAGTCCACTCAGACCGTGCAGGGGCCCGACTCCGCCGCCTGCGG
ACTCTTCTGTTGCATGTTCTTGCATGCCTTCGTGCACTGGCCCGACCGACCCATGGACGGAAACCCCACC
ATGAACTTGCTGACGGGGGTGCCCAACGGCATGCTACAATCGCCACAGGTGCTGCCCACCCTCAGGCGCA
ACCAGGAGGAACTCTACCGCTTCCTCGCGCGCCACTCCCCTTACTTTCGCTCCCACCGCGCCGCCATCGA
ACACGCCACCGCTTTTGACAAAATGAAACAACTGCGTGTATCTCAATAAACAGCACTTTTATTTTACATG
CACTGGAGTATATGCAAGTTATTTAAAAGTCGAAGGGGTTCTCGCGCTCGTCGTTGTGCGCCGCGCTGGG
GAGGGCCACGTTGCGGTACTGGTACTTGGGCTGCCACTTGAACTCGGGGATCACCAGTTTGGGCACTGGG
GTCTCGGGGAAGGTCTCGCTCCACATGCGCCGGCTCATCTGCAGGGCGCCCAGCATGTCCGGGGCGGAGA
TCTTGAAATCGCAGTTGGGGCCGGTGCTCTGCGCGCGCGAGTTGCGGTACACGGGGTTGCAGCACTGGAA
CACCATCAGACTGGGGTACTTCACACTAGCCAGCACGCTCTTGTCGCTGATCTGATCCTTGTCCAGATCC
TCGGCGTTGCTCAGGCCGAACGGGGTCATCTTGCACAGCTGGCGTCCCAGGAAGGGCACGCTCTGAGGCT
TGTGGTTACACTCGCAGTGCACGGGCATCAGCATCATCCCCGCGCCGCGCTGCATATTCGGGTAGAGGGC
CTTGACAAAGGCCGCGATCTGCTTGAAAGCTTGCTGGGCCTTGGCCCCCTCGCTGAAAAACAGGCCGCAG
CTCTTCCCGCTGAACTGGTTATTCCCACACCCGGCATCCTGCACGCAGCAGCGCGCGTCATGGCTGGTCA
GTTGCACCACGCTCCGTCCCCAGCGGTTCTGGGTCACCTTAGCCTTGCTGGGCTGCTCCTTCAACGCGCG
CTGCCCGTTCTCGCTGGTCACATCCATCTCCACCACGTGGTCCTTGTGGATCATCATCGTCCCGTGCAGA
CACTTGAGCTGGCCTTCCACCTCGGTGCAGCCGTGATCCCACAGGGCGCAACCGGTGCACTCCCAGTTCT
TGTGCGCAATCCCGCTGTGGCTGAAGATGTAACCTTGCAACATGCGGCCCATGATGGTGCTAAATGCTTT
CTGGGTGGTGAAGGTCAGTTGCATCCCGCGGGCCTCCTCGTTCATCCAGGTCTGGCACATCTTCTGGAAG
ATCTCGGTCTGCTCGGGCATGAGCTTGTAAGCATCGCGCAGGCCGCTGTCGACGCGGTAGCGTTCCATCA
GCACGTTCATGGTATCCATGCCCTTCTCCCAGGACGAGACCAGAGGCAGACTCAGAGGGTTGCGTACGTT
CAGGACACCGGGGGTCGCGGGCTCGACGATGCGTTTTCCGTCCTTGCCTTCCTTCAATAGAACCGGCGGC
TGGCTGAATCCCACTCCCACGATCACGGCATCTTCCTGGGGCATCTCTTCGTCGGGGTCTACCTTGGTCA
CATGCTTGGTCTTTCTGGCTTGCTTCTTTTTTGGAGGGCTGTCCACGGGGAGCACGTCCTCCTCGGAAGA
CCCGGAGCCCACCCGCTGATACTTTCGGCGCTTGGTGGGCAGAGGAGGTGGCGGCGAGGGGCTCCTCTCC
TGCTCCGGCGGATAGCGCGCCGACCCGTGGCCCCGGGGCGGAGTGGCCTCTCGGCCCATGAACCGGCGCA
CGTCCTGACTGCCGCCGGCCATTGTTTCCTAGGGAAGATGGAGGAGCAGCCGCGTAAGCAGGAGCAGGA
GGAGGACTTAACCACCCACGAGCAACCCAAAATCGAGCAGGACCTGGGCTTCGAAGAGCCGGCTCGTCTA
GAACCCCACAGGATGAACAGGAGCACGAGCAAGACGCAGGCCAGGAGGAGACCGACGCTGGGCTCGAGC
ATGGCTACCTGGGAGGAGAGGAGGATGTGCTGCTGAAACACCTGCAGCGCCAGTCCCTCATCCTCCGGGA
CGCCCTGGCCGACCGGAGCGAAACCCCCCTCAGCGTCGAGGAGCTGTGTCGGGCCTACGAGCTCAACCTC
TTCTCGCCGCGCGTACCCCCCAAACGCCAGCCCAACGGCACCTGCGAGCCCAACCCGCGTCTCAACTTCT
```

-continued

```
ATCCCGTCTTTGCGGTCCCCGAAGCCCTCGCCACCTATCACATCTTTTTCAAGAACCAAAAGATCCCCGT
CTCCTGCCGCGCCAACCGCACCAGCGCCGACGCGCTCCTCGCTtTGGGGCCCGGCGCGCGCATACCTGAT
ATCGCTTCCCTGGAAGAGGTGCCCAAGATCTTCGAAGGGCTCGGTCGGGACGAGACGCGCGCGGCGAACG
CTCTGAAAGAAACAGCAGAGGAAGAGGGTCACACTAGCGCCCTGGTAGAGTTGGAAGGCGACAACGCCAG
GCTGGCCGTGCTCAAGCGCAGCGTCGAGCTtACCCACTTCGCCTACCCCGCCGTCAACCTCCCGCCCAAG
GTCATGCGTCGCATCATGGATCAGCTCATCATGCCCCACATCGAGGCCCTCGATGAAAGTCAGGAGCAGC
GCCCCGAGGACGCCCGGCCCGTGGTCAGCGACGAGATGCTCGCGCGCTGGCTCGGGACCCgCGACCCCCA
GGCTTTGGAACAGCGGCGCAAaCTCATGCTGGCCGTGGTCCTGGTcACCCTtGAGCTcGAATGCATGCGC
CGCTTtTTCAGCGACCCCGAGACCCTGCGCAAGGTCGAGGAGACCCTGCACTACACTTTCAGgCACGGTT
TCGTCAGGCAGGCCTGCAAGATCTCCAACGTGGAGCTGACCAACCTGGTCTCCTGCCTGGGGATCCTGCA
CGAGAACCGCCTGGGcCAGACCGTGCTCCACTCTACCCTGAAGGGCGAGGCGCGGCGGGACTATGTCCGC
GACTGCGTCTTTCTcTTTCTcTGCCACACATGGCAAGCgGCCATGGGCGTGTGGCAgCAGTGTCTCGAGG
ACGAgAACCTaAAGGAGCTGGACAAGCTTCTTGCTAGAAAcCTTAAAAAGCTGTGGACGGGCTTCGACGA
GCGCACCGTCGCCTCGGACCTGGCCGAGATCGTcTTCCCCGAGCGCCTGAGaCAGACGCTGAAAGGCGGG
CTGCCCGACTTCATGAGCCAGAGCATGTTGCAAAACTACCGCACTTTCATTCTtGAGCGATCaGGcATcC
TGCCCGCCACCTGCAACGCcTTCCCCTCCGACTTTGTaCCGCTGAGCTACCGCGAGTGTCCCCCGCCGCT
GTGGAGCCACTGCTACCTCTTGCAGCTGGCCAACTACATCGCCTACCACTCGGACGTGATCGAGGACGTG
AGCGGCGAGGGGCTGCTCGAGTGCCACTGtCGCTGCAACCTGTGCTCCCCGCAtCGCTCCCTGGTCTGCA
ACCCCCAGCTcCTgAGCGAGACCCAGGTCATCGGTACCTTcGAGCTGCAAGGTCCGCAGGAGTCCACCGC
TCCGCTGAAACTCACGCCGGGGTTGTGGACTTCCGCGTACCTGCGCAAATTTGTACCCGAaGACTACCAC
GCCCAtGAGATAAAGTTCTTtGAGGACCAATCGCGTCCGCAGCACGCGGATCTCACGGCCTGCGTCATCA
CCCAGGGCGCgATCCTCGCCCAATTGCACGCCATCCAAAAATCCCGCCAAGAGTTTCTTCTGAAAAAGGG
TAGAGGGGTCTACCTGGACCCCCAGACGGGCGAgGTGCTCAACCCGGGTCTCCCCCAGCATGCCGAGGAA
GAAGCAGGAGCCGCTAGTGGAGGAGATGGAAGAAGAATGGGACAGCCAGGCAGAGGAGGACGAATGGGAG
GAGGAGACAGAGGAGGAAGAATTGGAAGAGGTGGAAGAGGAGCAGGCAACAGAGCAGCCCGTCGCCGCAC
CATCCGCGCCGGCAGCCCCGCCGGTCACGGATACAACCTCCGCTCCGGTcAAGCCTCCTCGTAGATGGGA
TCaAGTGAAGGGTGACGGTAAGCACGAGCGGCAGGGCTACCGATCATGGAGGGCCCACAAAGCCGCGATC
ATCGCCTGCTTGCAAGACTGCGGGGGGAACATCGCTTTCGCCCGCCGCTACCTGCTCTTCCACCGCGGGG
TgAACATCCCCCGCAACGTGTTGCATTACTACCGTCACCTTCACAGCTAAGAAAAAGCAAGTcAAAGGAG
TCGCCGGAGGAGGAGgagGaggCCTGAGGATCGCGGCGAACGAGCCCTTGACCACCAGGGAGCTGAGGAA
CCGGATCTTCCCCACTCTTTATGCCATTTTTCAGCAGAGTCGAGGTCAGCAGCAAGAGCTCAAAGTAAAA
AACCGGTCTCTGCGCTCGCTCACCCGCAGTTGCTTGTACCACAAAAACGAAGATCAGCTGCAGCGCACTC
TCGAAGACGCCGAGGCTCTGTTCCACAAGTACTGCGCGCTCACTCTTAAAGACTAAGGCGCGCCCACCCG
GAAAAAGGCGGGAATTACCTCATCGCCACCATGAGCAAGGAGATTCCCACCCCTTACATGTGGAGCTAT
CAGCCCCAAATGGGCCTGGCCGCGGGCGCCTCCCAGGACTACTCCACCCGCATGAACTGGCTCAGTGCCG
GCCCCTCGATGATCTCACGGGTCAACGGGGTCCGCAGTCATCGAAACCAGATATTGTTGGAGCAGGCGGC
GGTCACCTCCACGCCCAGGGCAAAGCTCAACCCGCGTAATTGGCCCTCCACCCTGGTGTATCAGGAAATC
CCCGGGCCGACTACCGTACTACTTCCGCGTGACGCACTGGCCGAAGTCCGCATGACTAACTCAGGTGTCC
AGCTGGCCGGCGGCGCTTCCCGGTGCCCGCTCCGCCCACAATCGGGTATAAAAACCCTGGTGATCCGAGG
CAGAGGCACACAGCTCAACGACGAGTTGGTGAGCTCTTCGATCGGTCTGCGACCGGACGGAGTGTTCCAA
```

-continued

```
CTAGCCGGAGCCGGGAGATCCTCCTTCACTCCCAACCAGGCCTACCTGACCTTGCAGAGCAGCTCTTCGG

AGCCTCGCTCCGGAGGCATCGGAACCCTCCAGTTTGTGGAGGAGTTTGTGCCCTCGGTCTACTTCAACCC

CTTCTCGGGATCGCCAGGCCTCTACCCGGACGAGTTCATACCGAACTTCGACGCAGTGAGAGAAGCGGTG

GACGGCTACGACTGAATGTCCCATGGTGACTCGGCTGAGCTCGCTCGGTTGAGGCATCTGGACCACTGCC

GCCGCCTGCGCTGCTTCGCCCGGGAGAGCTGCGGACTCATCTACTTTGAGTTTCCCGAGGAGCACCCCAA

CGGCCCTGCACACGGAGTGCGGATCACCGTAGAGGGCACCACCGAGTCTCACCTGGTCAGGTTCTTCACC

CAGCAACCCTTCCTGGTCGAGCGGGACCGGGGCGCCACCACCTACACCGTCTACTGCATCTGTCCAACCC

CGAAGTTGCATGAGAATTTTTGTTGTACTCTTTGTGGTGAGTTTAATAAAAGCTAAACTCTTGCAATACT

CTGGACCTTGTCGTCGTCAACTCAACGAGACCGTCTACCTCACCAACCAGACTGAGGTAAAACTCACCTG

CAGACCACACAAGACCTATATCATCTGGTTCTTCGAGAACACCTCATTTGCAGTCTCCAACACTCACTGC

ActagtCCATGAACTGATGTTGATTAAAAGCCCAAAAACCAATCAGCCCCTTCCCCCATTTCCCCATCCC

CCAATTACTCATAAAAAATAAATCATTGGAATTAATCATTCAATAAAGATCACTTACTTGAAATCTGAAA

GTATGTCTCTGGTGTAGTTGTTCAGCAGCACCTCGGTACCCTCCTCCCAGCTCTGGTACTCCAGTCCCCG

GCGGGCGGCGAACTTCCTCCACACCTTGAAAGGGATGTCAAATTCCTGGTCCACAATTTTCATTGTCTTC

CCTCTCAGATGGCAAAGAGGCTCCGGGTGGAAGATGACTTCAACCCCGTCTACCCCTATGGCTACGCGCG

GAATCAGAATATCCCCTTCCTCACTCCCCCCTTTGTCTCCTCCGATGGATTCAAAAACTTCCCCCCTGGG

GTCCTGTCACTTAAACTGGCTGATCCAATCACCATCAACAATGGGGATGTCTCACTTAAGGTGGGAGGGG

GACTTGCTGTAGAGCAACAGACTGGTAACCTAAGCGTAAACCCTGATGCACCCTTGCAAGTTGCAAGTGA

TAAGCTACAGCTTGCTCTGGCTCCTCCATTCGAGGTCAGAGATGGAAAGCTTGCTTTAAAGGCAGGTAAT

GGATTAAAAGTACTAGATAATTCCATTACTGGATTGACTGGATTATTGAATACACTTGTGGTATTAACTG

GAAGGGGAATAGGAACGGAGGAATTAAAAAATGACGATGGTGTAACAAACAAAGGAGTCGGCTTGCGTGT

AAGACTTGGAGATGACGGCGGGCTGACATTTGATAAAAAGGGTGATTTAGTAGCCTGGAATAAAAAAGAT

GACAGGCGCACCCTGTGGACAACCCCTGACACATCTCCAAATTGCAAATGAGTACAGAAAAGGATTCTA

AACTTACGTTGACACTTACAAAGTGTGGAAGTCAGGTTCTGGGAAATGTATCTTTACTTGCAGTTACAGG

TGAATATCATCAAATGACTGCTACTACAAAGAAGGATGTAAAATATCTTTACTATTTGATGAGAATGGA

ATTCTATTACCATCTTCGTCCCTTAGCAAAGATTATTGGAATTACAGAAGTGATGATTCTATTGTATCTC

AAAAATATAATAATGCAGTTCCATTCATGCCAAACCTGACAGCTTATCCAAAACCAAGCGCTCAAAATGC

AAAAAACTATTCAAGAACTAAAATCATAAGTAATGTCTACTTAGGTGCTCTTACCTACCAACCTGTAATT

ATCACTATTGCATTTAATCAGGAAACTGAAAATGGATGTGCTTATTCTATAACATTTACCTTCACTTGGC

AAAAAGACTATTCTGCCCAACAGTTTGATGTTACATCTTTTACCTTCTCATATCTTACCCAAGAGAACAA

AGACAAAGACTAATAAAATGTTTTGAACTGAATTTATGAATCTTTATTTATTTTTACACCAGCACGGGTA

GTCAGTTTCCCACCACCAGCCCATTTcacagtgtaaacAGTCCTTTCTCCCCGGCTGGCCTTAAAAAGCA

TCATATCATGGGTAACAGACATATTCTTAGGTGTTATATTCCACACGGTTTCCTGTCGAGCCAAACGCTC

ATCAGTGATATTAATAAACTCCCCGGGCAGCTCACTTAAGTTCATGTCGCTGTCCAGCTGCTGAGCCACA

GGCTGCTGTCCAACTTGCGGTTGCTTAACGGGCGGCGAAGGAGAAGTCCACGCCTACATGGGGGTAGAGT

CATAATCGTGCATCAGGATAGGGCGGTGGTGCTGCAGCAGCGCGCGAATAAACTGCTGCCGCCGCCGCTC

CGTCCTGCAGGAATACAACATGGCAGTGGTCTCCTCAGCGATGATTCGCACCGCCCGCAGCATAAGGCGC

CTTGTCCTCCGGGCACAGCAGCGCACCCTGATCTCACTTAAATCAGCACAGTAACTGCAGCACAGCACCA

CAATATTGTTCAAAATCCCACAGTGCAAGGCGCTGTATCCAAAGCTCATGGCGGGGACCACAGAACCCAC

GTGGCCATCATACCACAAGCGCAGGTAGATTAAGTGGCGACCCCTCATAAACACGCTGGACATAAACATT

ACCTCTTTTGGCATGTTGTAATTCACCACCTCCCGGTACCATATAAACCTCTGATTAAACATGGCGCCAT
```

```
CCACCACCATCCTAAACCAGCTGGCCAAAACCTGCCCGCCGGCTATACACTGCAGGGAACCGGGACTGGA

ACAATGACAGTGGAGAGCCCAGGACTCGTAACCATGGATCATCATGCTCGTCATGATATCAATGTTGGCA

CAACACAGGCACACGTGCATACACTTCCTCAGGATTACAAGCTCCTCCCGCGTTAGAACCATATCCCAGG

GAACAACCCATTCCTGAATCAGCGTAAATCCCACACTGCAGGGAAGACCTCGCACGTAACTCACGTTGTG

CATTGTCAAAGTGTTACATTCGGGCAGCAGCGGATGATCCTCCAGTATGGTAGCGCGGGTTTCTGTCTCA

AAAGGAGGTAGACGATCCCTACTGTACGGAGTGCGCCGAGACAACCGAGATCGTGTTGGTCGTAGTGTCA

TGCCAAATGGAACGCCGGACGTAGTCATTGAAATGGATTCTCTTGCGTACCTTGTCGTACTTCTGCCAGC

AGAAAGTGGCTCGGGAACAGCAGATACCTTTCCTCCTGCTGTCCTTCCGCTGCTGACGCTCAGTCATCCA

ACTGAAGTACAGCCATTCCCGCAGGTTCTCCAGCAGCTCCTGTGCATCTGATGAAACAAAAGTCCCGTCG

ATGCGGATTCCCCTTAAAACATCAGCCAGGACATTGTAGGCCATCCCAATCCAGTTAATGCATCCTGATC

TATCATGAAGAGGAGGTGGGGGAAGAACTGGAAGAACCATTTTTATTCCAAGCGGTCTCGAAGGACGATA

AAGTGCAAGTCACGCAGGTGACAGCGTTCCCCGCCGCTGTGCTGGTGGAAACAGACAGCCAGGTCAAAAC

CCACTCTATTTTCAAGGTGCTCGACTGTGGCTTCGAGCAGTGGCTCTACGCGTACATCCAGCATAAGAAT

CACATTAAAGGCTGGACCTCCATCGATTTCATCAATCATCAGGTTACACTCATTCACCATCCCCAGGTAA

TTCTCATTTTTCCAGCCTTGGATTATTTCTACAAATTGTTGGTGTAAGTCCACTCCGCACATGTGGAAAA

GTTCCCACAGCGCCCCCTCCACTTTCATAATCAGGCAGACCTTCATATTAGAAACAGATCCTGCTGCTCC

ACCACCTGCAGCGTGTTCAAAACAACAAGATTCAATGAGGTTCTGCCCTCTGCCCTCAGCTCACGTCTCA

GCGTCAGCTGCAAAAAGTCACTCAAGTCCTCAGCCACTACAGCTGACAATTCAGAGCCAGGGCTAAGCGT

GGGACTGGCAAGCGTGAGTGAGTACTTTAATGCTCCAAAGCTAGCACCCAAAAACTGCATGCTGGAATAA

GCTCTCTTTGTGTCACCGGTGATGCCTTCCAATAGGTGAGTGATAAAGCGAGGTAGTTTTTCTTTAATCA

TTTGAGTAATAGAAAAGTCCTCTAAATAAGTCACTAGGACCCCAGGAACCACAATGTGGTAGCTGACAGC

GTGTCGCTCAAGCATGGTTAGTAGAGATGAGAGTCTGAAAAACAGAAAGCATGCACTAAACCAGAGTTGC

CAGTCTCACTGAAGGAAAAATCACTCTCTCCAGCAGCAAAGTGCCCACTGGGTGGCCCTCTCGGACATAC

AAAAATCGATCCGTGTGGTTAAAGAGCAGCACAGTTAGCTCCTGTCTTCTCCCAGCAAAGATCACATCGG

ACTGGGTTAGTATGCCCCTGGAATGGTAGTCATTCAAGGCCATAAATCTGCCTTGGTAGCCATTAGGAAT

CAGCACGCTCACTCTCAAGTGAACCAAAACCACCCCATGCGGAGGAATGTGGAAAGATTCTGGGCAAAAA

AAGGTATATCTATTGCTAGTCCCTTCCTGGACGGGAGCAATCCCTCCAGGGCTATCTATGAAAGCATACA

GAGATTCAGCCATAGCTCAGCCCGCTTACCAGTAGACAGAGAGCACAGCAGTACAAGCGCCAACAGCAGC

GACTGACTACCCACTGACCCAGCTCCCTATTTAAAGGCACCTTACACTGACGTAATGACCAAAGGTCTAA

AAACCCCGCCAAAAAAACACACGCCCTGGGTGTTTTTCGCGAAAACACTTCCGCGTTCTCACTTCCTC

GTATCGATTTCGTGACTCAACTTCCGGGTTCCCACGTTACGTCACTTCTGCCCTTACATGTAACTCAGCC

GTAGGGCGCCATCTTGCCCACGTCCAAAATGGCTTCCATGTCCGGCCACGCCTCCGCGGCGACCGTTAGC

CGTGCGTCGTGACGTCATTTGCATCACCGTTTCTCGTCCAATCAGCGTTGGCTCCGCCCCAAAACCGTTA

AAATTCAAAAGCTCATTTGCATATTAACTTTTGTTTACTTTGTGGGTATATTATTGATGATGatttaaa tatTATGCGGTGTGAAATACCGCACAGATGCGTAAGGAGAAAATACCGCATCAGGCGCTCTTCCGCTTCC

TCGCTCACTGACTCGCTGCGCTCGGTCGTTCGGCTGCGGCGAGCGGTATCAGCTCACTCAAAGGCGGTAA

TACGGTTATCCACAGAATCAGGGGATAACGCAGGAAAGAACATGTGAGCAAAAGGCCAGCAAAAGGCCAG

GAACCGTAAAAAGGCCGCGTTGCTGGCGTTTTTCCATAGGCTCCGCCCCCCTGACGAGCATCACAAAAAT

CGACGCTCAAGTCAGAGGTGGCGAAACCCGACAGGACTATAAAGATACCAGGCGTTTCCCCCTGGAAGCT

CCCTCGTGCGCTCTCCTGTTCCGACCCTGCCGCTTACCGGATACCTGTCCGCCTTTCTCCCTTCGGGAAG
```

-continued

CGTGGCGCTTTCTCATAGCTCACGCTGTAGGTATCTCAGTTCGGTGTAGGTCGTTCGCTCCAAGCTGGGC

TGTGTGCACGAACCCCCCGTTCAGCCCGACCGCTGCGCCTTATCCGGTAACTATCGTCTTGAGTCCAACC

CGGTAAGACACGACTTATCGCCACTGGCAGCAGCCACTGGTAACAGGATTAGCAGAGCGAGGTATGTAGG

CGGTGCTACAGAGTTCTTGAAGTGGTGGCCTAACTACGGCTACACTAGAAGGACAGTATTTGGTATCTGC

GCTCTGCTGAAGCCAGTTACCTTCGGAAAAAGAGTTGGTAGCTCTTGATCCGGCAAACAAACCACCGCTG

GTAGCGGTGGTTTTTTTGTTTGCAAGCAGCAGATTACGCGCAGAAAAAAAGGATCTCAAGAAGATCCTTT

GATCTTTTCTACGGGGTCTGACGCTCAGTGGAACGAAAACTCACGTTAAGGGATTTTGGTCATGAGATTA

TCAAAAAGGATCTTCACCTAGATCCTTTTAAATTAAAAATGAAGTTTTAAATCAATCTAAAGTATATATG

AGTAAACTTGGTCTGACAGTTACCAATGCTTAATCAGTGAGGCACCTATCTCAGCGATCTGTCTATTTCG

TTCATCCATAGTTGCCTGACTCCCCGTCGTGTAGATAACTACGATACGGGAGGGCTTACCATCTGGCCCC

AGTGCTGCAATGATACCGCGAGACCCACGCTCACCGGCTCCAGATTTATCAGCAATAAACCAGCCAGCCG

GAAGGGCCGAGCGCAGAAGTGGTCCTGCAACTTTATCCGCCTCCATCCAGTCTATTAATTGTTGCCGGGA

AGCTAGAGTAAGTAGTTCGCCAGTTAATAGTTTGCGCAACGTTGTTGCCATTGCTGCAGGCATCGTGGTG

TCACGCTCGTCGTTTGGTATGGCTTCATTCAGCTCCGGTTCCCAACGATCAAGGCGAGTTACATGATCCC

CCATGTTGTGCAAAAAAGCGGTTAGCTCCTTCGGTCCTCCGATCGTTGTCAGAAGTAAGTTGGCCGCAGT

GTTATCACTCATGGTTATGGCAGCACTGCATAATTCTCTTACTGTCATGCCATCCGTAAGATGCTTTTCT

GTGACTGGTGAGTACTCAACCAAGTCATTCTGAGAATAGTGTATGCGGCGACCGAGTTGCTCTTGCCCGG

CGTCAACACGGGATAATACCGCGCCACATAGCAGAACTTTAAAAGTGCTCATCATTGGAAAACGTTCTTC

GGGGCGAAAACTCTCAAGGATCTTACCGCTGTTGAGATCCAGTTCGATGTAACCCACTCGTGCACCCAAC

TGATCTTCAGCATCTTTTACTTTCACCAGCGTTTCTGGGTGAGCAAAAACAGGAAGGCAAAATGCCGCAA

AAAAGGGAATAAGGGCGACACGGAAATGTTGAATACTCATACTCTTCCTTTTTCAATATTATTGAAGCAT

TTATCAGGGTTATTGTCTCATGAGCGGATACATATTTGAATGTATTTAGAAAAATAAACAAATAGGGGTT

CCGCGCACATTTCCCCGAAAAGTGCCACCTGACGTCTAAGAAACCATTATTATCATGACATTAACCTATA

AAAATAGGCGTATCACGAGGCCCTTTCGTCTTCAAGAATTgatttaaat

>CMVdel134 including 2x TO;

SEQ ID NO: 219

GTTGACATTGATTATTGACTAGTTATTAATAGTAATCAATTACGGGGTCATTAGTTCATAGCCCATATAT

GGAGTTCCGCGTTACATAACTTACGGTAAATGGCCCGCCTGGCTGACCGCCCAACGACCCCCGCCCATTG

ACGTCAATAATGACGTATGTTCCCATAGTAACGCCAATAGGGACTTTCCATTGACGTCAATGGGTGGAGT

ATTTACGGTAAACTGCCCACTTGGCAGTACATCAAGTGTATCATATGCCAAGTACGCCCCCTATTGACGT

CAATGACGGTAAATGGCCCGCCTGGCATTATGCCCAGTACATGACCTTATGGGACTTTCCTACTTGGCAG

TACATCTACGTATTAGTCATCGCTATTACCATGGTGATGCGGTTTTGGCAGTACATCAATGGGCGTGGAT

AGCGGTTTGACTCACGGGGATTTCCAAGTCTCCACCCCATTGACGTCAATGGGAGTTTGTTTTGGCACCA

AAATCAACGGGACTTTCCAAAATGTCGTAACAACTCCGCCCCATTGACGCAAATGGGCGGTAGGCGTGTA

CGGTGGGAGGTCTATATAAGCAGAGCTCTCCCTATCAGTGATAGAGATCTCCCTATCAGTGATAGAGATC

GTCGACGAGCTCGTTTAGTGAACCGTCAGATCGCCTGGAGACGCCATCCACGCTGTTTTGACCTCCATAG

AAGACACCGGGACCGATCCAGCCTCCGCGGCCGGGAACGGTGCATTGGAA

SEQUENCE LISTING (226 sequences)

SEQ ID NO: 1 - protein, 1256 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 2 - protein, 1243 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDD

SEQ ID NO: 3 - protein, 1191 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQ

SEQ ID NO: 4 - protein, 664 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSP

SEQ ID NO: 5 - protein, 194 aa, Artificial Sequence
  Synthetic Construct
ITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVC

SEQ ID NO: 6 - protein, 1286 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTGSGGYIPEAPRDGQAYVRKDGEWVLLSTFL

SEQ ID NO: 7 - protein, 1273 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDGSGGYIPEAPRDGQAYVRKDGEWVLLSTFL

SEQ ID NO: 8 - protein, 1221 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQGSGGYIPEAPRDGQAYVRKDGEWVLLSTFL

SEQ ID NO: 9 - protein, 695 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGGYIPEAPRDGQAYVRKDGEWVLLSTFL

SEQ ID NO: 10 - protein, 225 aa, Artificial Sequence
  Synthetic Construct
ITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGGSGGYIPEAPRDGQAYVRKDGEWVLLSTFL

SEQ ID NO: 11 - protein, 1256 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 12 - protein, 1243 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDD

SEQ ID NO: 13 - protein, 1191 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQ

SEQ ID NO: 14 - protein, 1286 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTGSGGYIPEAPRDGQAYVRKDGEWVLLSTFL

SEQ ID NO: 15 - protein, 1273 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDGSGGYIPEAPRDGQAYVRKDGEWVLLSTFL

SEQ ID NO: 16 - protein, 1221 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQGSGGYIPEAPRDGQAYVRKDGEWVLLSTFL

SEQ ID NO: 17 - protein, 1256 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 18 - protein, 1243 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDD

SEQ ID NO: 19 - protein, 1191 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQ

SEQ ID NO: 20 - protein, 1286 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTGSGGYIPEAPRDGQAYVRKDGEWVLLSTFL

SEQ ID NO: 21 - protein, 1273 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDGSGGYIPEAPRDGQAYVRKDGEWVLLSTFL

SEQ ID NO: 22 - protein, 1221 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQGSGGYIPEAPRDGQAYVRKDGEWVLLSTFL

SEQ ID NO: 23 - protein, 1256 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 24 - protein, 1243 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDD

SEQ ID NO: 25 - protein, 1191 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQ

SEQ ID NO: 26 - protein, 1286 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTGSGGYIPEAPRDGQAYVRKDGEWVLLSTFL

SEQ ID NO: 27 - protein, 1273 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDGSGGYIPEAPRDGQAYVRKDGEWVLLSTFL

SEQ ID NO: 28 - protein, 1221 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQGSGGYIPEAPRDGQAYVRKDGEWVLLSTFL

SEQ ID NO: 29 - protein, 1273 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 30 - protein, 1260 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDD

SEQ ID NO: 31 - protein, 1208 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQ

SEQ ID NO: 32 - protein, 681 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSP

SEQ ID NO: 33 - protein, 211 aa, Artificial Sequence
  Synthetic Construct
MFVFLVLLPLVSSQCVNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVC

SEQ ID NO: 34 - protein, 1303 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTGSGGYIPEAPRDGQAYVRKDGEWVLLSTFL

SEQ ID NO: 35 - protein, 1290 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDGSGGYIPEAPRDGQAYVRKDGEWVLLSTFL

SEQ ID NO: 36 - protein, 1238 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQGSGGYIPEAPRDGQAYVRKDGEWVLLSTFL

SEQ ID NO: 37 - protein, 712 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGGYIPEAPRDGQAYVRKDGEWVLLSTFL

SEQ ID NO: 38 - protein, 242 aa, Artificial Sequence
  Synthetic Construct
MFVFLVLLPLVSSQCVNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGGSGGYIPEAPRDGQAYVRKDGEWVLLSTFL

SEQ ID NO: 39 - protein, 1273 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 40 - protein, 1260 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDD

SEQ ID NO: 41 - protein, 1208 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQ

SEQ ID NO: 42 - protein, 1303 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTGSGGYIPEAPRDGQAYVRKDGEWVLLSTFL

SEQ ID NO: 43 - protein, 1290 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDGSGGYIPEAPRDGQAYVRKDGEWVLLSTFL

SEQ ID NO: 44 - protein, 1238 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQGSGGYIPEAPRDGQAYVRKDGEWVLLSTFL

SEQ ID NO: 45 - protein, 1273 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 46 - protein, 1260 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDD

SEQ ID NO: 47 - protein, 1208 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQ

SEQ ID NO: 48 - protein, 1303 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTGSGGYIPEAPRDGQAYVRKDGEWVLLSTFL

SEQ ID NO: 49 - protein, 1290 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDGSGGYIPEAPRDGQAYVRKDGEWVLLSTFL

SEQ ID NO: 50 - protein, 1238 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQGSGGYIPEAPRDGQAYVRKDGEWVLLSTFL

SEQ ID NO: 51 - protein, 1273 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 52 - protein, 1260 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDD

SEQ ID NO: 53 - protein, 1208 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQ

SEQ ID NO: 54 - protein, 1303 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTGSGGYIPEAPRDGQAYVRKDGEWVLLSTFL

SEQ ID NO: 55 - protein, 1290 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDGSGGYIPEAPRDGQAYVRKDGEWVLLSTFL

SEQ ID NO: 56 - protein, 1238 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQGSGGYIPEAPRDGQAYVRKDGEWVLLSTFL

SEQ ID NO: 57 - protein, 1282 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTYIPEAPRDGQAYVRKDGEWVLLSTFL

SEQ ID NO: 58 - protein, 1269 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDYIPEAPRDGQAYVRKDGEWVLLSTFL

SEQ ID NO: 59 - protein, 1217 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIPEAPRDGQAYVRKDGEWVLLSTFL

SEQ ID NO: 60 - protein, 690 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPYIPEAPRDGQAYVRKDGEWVLLSTFL

SEQ ID NO: 61 - protein, 220 aa, Artificial Sequence
  Synthetic Construct
ITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCYIPEAPRDGQAYVRKDGEWVLLSTFL

SEQ ID NO: 62 - protein, 1282 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTYIPEAPRDGQAYVRKDGEWVLLSTFL

SEQ ID NO: 63 - protein, 1269 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDYIPEAPRDGQAYVRKDGEWVLLSTFL

SEQ ID NO: 64 - protein, 1217 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIPEAPRDGQAYVRKDGEWVLLSTFL

SEQ ID NO: 65 - protein, 1282 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTYIPEAPRDGQAYVRKDGEWVLLSTFL

SEQ ID NO: 66 - protein, 1269 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDYIPEAPRDGQAYVRKDGEWVLLSTFL

SEQ ID NO: 67 - protein, 1217 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIPEAPRDGQAYVRKDGEWVLLSTFL

SEQ ID NO: 68 - protein, 1282 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTYIPEAPRDGQAYVRKDGEWVLLSTFL

SEQ ID NO: 69 - protein, 1269 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDYIPEAPRDGQAYVRKDGEWVLLSTFL

SEQ ID NO: 70 - protein, 1217 aa, Artificial Sequence
  Synthetic Construct
LTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIPEAPRDGQAYVRKDGEWVLLSTFL

SEQ ID NO: 71 - protein, 1299 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTYIPEAPRDGQAYVRKDGEWVLLSTFL

SEQ ID NO: 72 - protein, 1286 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDYIPEAPRDGQAYVRKDGEWVLLSTFL

SEQ ID NO: 73 - protein, 1234 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIPEAPRDGQAYVRKDGEWVLLSTFL

SEQ ID NO: 74 - protein, 707 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPYIPEAPRDGQAYVRKDGEWVLLSTFL

SEQ ID NO: 75 - protein, 237 aa, Artificial Sequence
  Synthetic Construct
MFVFLVLLPLVSSQCVNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCYIPEAPRDGQAYVRKDGEWVLLSTFL

SEQ ID NO: 76 - protein, 1299 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTYIPEAPRDGQAYVRKDGEWVLLSTFL

SEQ ID NO: 77 - protein, 1286 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDYIPEAPRDGQAYVRKDGEWVLLSTFL

SEQ ID NO: 78 - protein, 1234 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIPEAPRDGQAYVRKDGEWVLLSTFL

SEQ ID NO: 79 - protein, 1299 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTYIPEAPRDGQAYVRKDGEWVLLSTFL

SEQ ID NO: 80 - protein, 1286 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDYIPEAPRDGQAYVRKDGEWVLLSTFL

SEQ ID NO: 81 - protein, 1234 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIPEAPRDGQAYVRKDGEWVLLSTFL

SEQ ID NO: 82 - protein, 1299 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTYIPEAPRDGQAYVRKDGEWVLLSTFL

SEQ ID NO: 83 - protein, 1286 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDYIPEAPRDGQAYVRKDGEWVLLSTFL

SEQ ID NO: 84 - protein, 1234 aa, Artificial Sequence
  Synthetic Construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGGSGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIPEAPRDGQAYVRKDGEWVLLSTFL

SEQ ID NO: 85 - protein, 13 aa, Artificial Sequence
  Synthetic Construct
SEPVLKGVKLHYT

SEQ ID NO: 86 - protein, 52 aa, Artificial Sequence
  Synthetic Construct
YIKWPWYIWLGFIAGLIAIVMVTIMLCCMTSCCSCLKGCCSCGSCCKFDEDD

SEQ ID NO: 87 - protein, 26 aa, Artificial Sequence
  Synthetic Construct
YIPEAPRDGQAYVRKDGEWVLLSTFL

SEQ ID NO: 88 - protein, 4 aa, Artificial Sequence
  Synthetic Construct
GSGG

SEQ ID NO: 89 - protein, 5 aa, Artificial Sequence
  Synthetic Construct
GGSGG

SEQ ID NO: 90 - protein, 4 aa, Artificial Sequence
  Synthetic Construct
RRAR

SEQ ID NO: 91 - protein, 4 aa, Artificial Sequence
  Synthetic Construct
GGSG

SEQ ID NO: 92 - protein, 17 aa, Artificial Sequence
  Synthetic Construct
MFVFLVLLPLVSSQCVN

SEQ ID NO: 93 - DNA, 3768 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacaca

SEQ ID NO: 94 - DNA, 3729 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgat

SEQ ID NO: 95 - DNA, 3573 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcag

SEQ ID NO: 96 - DNA, 1992 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagcccc

SEQ ID NO: 97 - DNA, 582 bp, Artificial Sequence
  Synthetic Construct
atcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgc

SEQ ID NO: 98 - DNA, 3856 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacaggcagcggcggctatatccctgaagctcctagagatggccaggcctacgtgcggaaagatggcgaatgggtcctgctgagcaccttcc

SEQ ID NO: 99 - DNA, 3817 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgatggcagcggcggctatatccctgaagctcctagagatggccaggcctacgtgcggaaagatggcgaatgggtcctgctgagcaccttcc

SEQ ID NO: 100 - DNA, 3661 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagggcagcggcggctatatccctgaagctcctagagatggccaggcctacgtgcggaaagatggcgaatgggtcctgctgagcaccttcc

SEQ ID NO: 101 - DNA, 2083 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggcggctatatccctgaagctcctagagatggccaggcctacgtgcggaaagatggcgaatgggtcctgctgagcaccttcc

SEQ ID NO: 102 - DNA, 673 bp, Artificial Sequence
  Synthetic Construct
atcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggtggcagcggcggctatatccctgaagctcctagagatggccaggcctacgtgcggaaagatggcgaatgggtcctgctgagcaccttcc

SEQ ID NO: 103 - DNA, 3816 bp, Artificial Sequence
  Synthetic Construct
ttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacaca

SEQ ID NO: 104 - DNA, 3729 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgat

SEQ ID NO: 105 - DNA, 3573 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcag

SEQ ID NO: 106 - DNA, 3904 bp, Artificial Sequence
  Synthetic Construct
ttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacaggcagcggcggctatatccctgaagctcctagagatggccaggcctacgtgcggaaagatggcgaatgggtcctgctgagcaccttcc

SEQ ID NO: 107 - DNA, 3817 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgatggcagcggcggctatatccctgaagctcctagagatggccaggcctacgtgcggaaagatggcgaatgggtcctgctgagcaccttcc

SEQ ID NO: 108 - DNA, 3661 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagggcagcggcggctatatccctgaagctcctagagatggccaggcctacgtgcggaaagatggcgaatgggtcctgctgagcaccttcc

SEQ ID NO: 109 - DNA, 3768 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacaca

SEQ ID NO: 110 - DNA, 3729 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgat

SEQ ID NO: 111 - DNA, 3573 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcag

SEQ ID NO: 112 - DNA, 3856 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacaggcagcggcggctatatccctgaagctcctagagatggccaggcctacgtgcggaaagatggcgaatgggtcctgctgagcaccttcc

SEQ ID NO: 113 - DNA, 3817 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgatggcagcggcggctatatccctgaagctcctagagatggccaggcctacgtgcggaaagatggcgaatgggtcctgctgagcaccttcc

SEQ ID NO: 114 - DNA, 3661 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagggcagcggcggctatatccctgaagctcctagagatggccaggcctacgtgcggaaagatggcgaatgggtcctgctgagcaccttcc

SEQ ID NO: 115 - DNA, 3768 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacaca

SEQ ID NO: 116 - DNA, 3729 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgat

SEQ ID NO: 117 - DNA, 3573 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcag

SEQ ID NO: 118 - DNA, 3856 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacaggcagcggcggctatatccctgaagctcctagagatggccaggcctacgtgcggaaagatggcgaatgggtcctgctgagcaccttcc

SEQ ID NO: 119 - DNA, 3817 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgatggcagcggcggctatatccctgaagctcctagagatggccaggcctacgtgcggaaagatggcgaatgggtcctgctgagcaccttcc

SEQ ID NO: 120 - DNA, 3661 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagggcagcggcggctatatccctgaagctcctagagatggccaggcctacgtgcggaaagatggcgaatgggtcctgctgagcaccttcc

SEQ ID NO: 121 - DNA, 3819 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacaca

SEQ ID NO: 122 - DNA, 3780 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgat

SEQ ID NO: 123 - DNA, 3624 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcag

SEQ ID NO: 124 - DNA, 2043 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaatagccct

SEQ ID NO: 125 - DNA, 633 bp, Artificial Sequence
  Synthetic Construct
atgttcgtgtttctggtgctgctgcctctggtgtccagccagtgtgtgaacatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgc

SEQ ID NO: 126 - DNA, 3907 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacaggcagcggcggctatatccctgaagctcctagagatggccaggcctacgtgcggaaagatggcgaatgggtcctgctgagcaccttcc

SEQ ID NO: 127 - DNA, 51 bp, Artificial Sequence
  Synthetic Construct
atgttcgtgtttctggtgctgctgcctctggtgtccagccagtgtgtgaac

SEQ ID NO: 128 - DNA, 51 bp, Artificial Sequence; identical to SEQ ID NO: 127
  Synthetic Construct

SEQ ID NO: 129 - DNA, 2134 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaatagccctggtggcagcggcggctatatccctgaagctcctagagatggccaggcctacgtgcggaaagatggcgaatgggtcctgctgagcaccttcc

SEQ ID NO: 130 - DNA, 724 bp, Artificial Sequence
  Synthetic Construct
atgttcgtgtttctggtgctgctgcctctggtgtccagccagtgtgtgaacatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggtggcagcggcggctatatccctgaagctcctagagatggccaggcctacgtgcggaaagatggcgaatgggtcctgctgagcaccttcc

SEQ ID NO: 131 - DNA, 3867 bp, Artificial Sequence
  Synthetic Construct
atgttcgtgtttctggtgctgctgcctctggtgtccagccagtgtgtgaacttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacaca

SEQ ID NO: 132 - DNA, 3780 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgat

SEQ ID NO: 133 - DNA, 3624 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcag

SEQ ID NO: 134 - DNA, 3955 bp, Artificial Sequence
  Synthetic Construct
atgttcgtgtttctggtgctgctgcctctggtgtccagccagtgtgtgaacttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacaggcagcggcggctatatccctgaagctcctagagatggccaggcctacgtgcggaaagatggcgaatgggtcctgctgagcaccttcc

SEQ ID NO: 135 - DNA, 3868 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgatggcagcggcggctatatccctgaagctcctagagatggccaggcctacgtgcggaaagatggcgaatgggtcctgctgagcaccttcc

SEQ ID NO: 136 - DNA, 3712 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagggcagcggcggctatatccctgaagctcctagagatggccaggcctacgtgcggaaagatggcgaatgggtcctgctgagcaccttcc

SEQ ID NO: 137 - DNA, 3819 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacaca

SEQ ID NO: 138 - DNA, 3780 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgat

SEQ ID NO: 139 - DNA, 3624 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcag

SEQ ID NO: 140 - DNA, 3907 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacaggcagcggcggctatatccctgaagctcctagagatggccaggcctacgtgcggaaagatggcgaatgggtcctgctgagcaccttcc

SEQ ID NO: 141 - DNA, 3868 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgatggcagcggcggctatatccctgaagctcctagagatggccaggcctacgtgcggaaagatggcgaatgggtcctgctgagcaccttcc

SEQ ID NO: 142 - DNA, 3712 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagggcagcggcggctatatccctgaagctcctagagatggccaggcctacgtgcggaaagatggcgaatgggtcctgctgagcaccttcc

SEQ ID NO: 143 - DNA, 3819 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacaca

SEQ ID NO: 144 - DNA, 3780 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgat

SEQ ID NO: 145 - DNA, 3624 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcag

SEQ ID NO: 146 - DNA, 3907 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacaggcagcggcggctatatccctgaagctcctagagatggccaggcctacgtgcggaaagatggcgaatgggtcctgctgagcaccttcc

SEQ ID NO: 147 - DNA, 3868 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgatggcagcggcggctatatccctgaagctcctagagatggccaggcctacgtgcggaaagatggcgaatgggtcctgctgagcaccttcc

SEQ ID NO: 148 - DNA, 3712 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagggcagcggcggctatatccctgaagctcctagagatggccaggcctacgtgcggaaagatggcgaatgggtcctgctgagcaccttcc

SEQ ID NO: 149 - DNA, 3844 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatatatccctgaagctcctagagatggccaggcctacgtgcggaaagatggcgaatgggtcctgctgagcaccttcc

SEQ ID NO: 150 - DNA, 3805 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattatatccctgaagctcctagagatggccaggcctacgtgcggaaagatggcgaatgggtcctgctgagcaccttcc

SEQ ID NO: 151 - DNA, 3649 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtatatccctgaagctcctagagatggccaggcctacgtgcggaaagatggcgaatgggtcctgctgagcaccttcc

SEQ ID NO: 152 - DNA, 2068 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagcccctatatccctgaagctcctagagatggccaggcctacgtgcggaaagatggcgaatgggtcctgctgagcaccttcc

SEQ ID NO: 153 - DNA, 658 bp, Artificial Sequence
  Synthetic Construct
atcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgctatatccctgaagctcctagagatggccaggcctacgtgcggaaagatggcgaatgggtcctgctgagcaccttcc

SEQ ID NO: 154 - DNA, 3892 bp, Artificial Sequence
  Synthetic Construct
ttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatatatccctgaagctcctagagatggccaggcctacgtgcggaaagatggcgaatgggtcctgctgagcaccttcc

SEQ ID NO: 155 - DNA, 3805 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattatatccctgaagctcctagagatggccaggcctacgtgcggaaagatggcgaatgggtcctgctgagcaccttcc

SEQ ID NO: 156 - DNA, 3649 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtatatccctgaagctcctagagatggccaggcctacgtgcggaaagatggcgaatgggtcctgctgagcaccttcc

SEQ ID NO: 157 - DNA, 3844 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatatatccctgaagctcctagagatggccaggcctacgtgcggaaagatggcgaatgggtcctgctgagcaccttcc

SEQ ID NO: 158 - DNA, 3805 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattatatccctgaagctcctagagatggccaggcctacgtgcggaaagatggcgaatgggtcctgctgagcaccttcc

SEQ ID NO: 159 - DNA, 3649 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtatatccctgaagctcctagagatggccaggcctacgtgcggaaagatggcgaatgggtcctgctgagcaccttcc

SEQ ID NO: 160 - DNA, 3844 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatatatccctgaagctcctagagatggccaggcctacgtgcggaaagatggcgaatgggtcctgctgagcaccttcc

SEQ ID NO: 161 - DNA, 3805 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattatatccctgaagctcctagagatggccaggcctacgtgcggaaagatggcgaatgggtcctgctgagcaccttcc

SEQ ID NO: 162 - DNA, 3649 bp, Artificial Sequence
  Synthetic Construct
ctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtatatccctgaagctcctagagatggccaggcctacgtgcggaaagatggcgaatgggtcctgctgagcaccttcc

SEQ ID NO: 163 - DNA, 3895 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatatatccctgaagctcctagagatggccaggcctacgtgcggaaagatggcgaatgggtcctgctgagcaccttcc

SEQ ID NO: 164 - DNA, 3856 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattatatccctgaagctcctagagatggccaggcctacgtgcggaaagatggcgaatgggtcctgctgagcaccttcc

SEQ ID NO: 165 - DNA, 3700 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtatatccctgaagctcctagagatggccaggcctacgtgcggaaagatggcgaatgggtcctgctgagcaccttcc

SEQ ID NO: 166 - DNA, 2119 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagcccctatatccctgaagctcctagagatggccaggcctacgtgcggaaagatggcgaatgggtcctgctgagcaccttcc

SEQ ID NO: 167 - DNA, 709 bp, Artificial Sequence
  Synthetic Construct
atgttcgtgtttctggtgctgctgcctctggtgtccagccagtgtgtgaacatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgctatatccctgaagctcctagagatggccaggcctacgtgcggaaagatggcgaatgggtcctgctgagcaccttcc

SEQ ID NO: 168 - DNA, 3943 bp, Artificial Sequence
  Synthetic Construct
atgttcgtgtttctggtgctgctgcctctggtgtccagccagtgtgtgaacttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatatatccctgaagctcctagagatggccaggcctacgtgcggaaagatggcgaatgggtcctgctgagcaccttcc

SEQ ID NO: 169 - DNA, 3856 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattatatccctgaagctcctagagatggccaggcctacgtgcggaaagatggcgaatgggtcctgctgagcaccttcc

SEQ ID NO: 170 - DNA, 3700 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtatatccctgaagctcctagagatggccaggcctacgtgcggaaagatggcgaatgggtcctgctgagcaccttcc

SEQ ID NO: 171 - DNA, 3895 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatatatccctgaagctcctagagatggccaggcctacgtgcggaaagatggcgaatgggtcctgctgagcaccttcc

SEQ ID NO: 172 - DNA, 3856 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattatatccctgaagctcctagagatggccaggcctacgtgcggaaagatggcgaatgggtcctgctgagcaccttcc

SEQ ID NO: 173 - DNA, 3700 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtatatccctgaagctcctagagatggccaggcctacgtgcggaaagatggcgaatgggtcctgctgagcaccttcc

SEQ ID NO: 174 - DNA, 3895 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatatatccctgaagctcctagagatggccaggcctacgtgcggaaagatggcgaatgggtcctgctgagcaccttcc

SEQ ID NO: 175 - DNA, 3856 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattatatccctgaagctcctagagatggccaggcctacgtgcggaaagatggcgaatgggtcctgctgagcaccttcc

SEQ ID NO: 176 - DNA, 3700 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccggtggcagcggctctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtatatccctgaagctcctagagatggccaggcctacgtgcggaaagatggcgaatgggtcctgctgagcaccttcc

SEQ ID NO: 177 - DNA, 3855 bp, Artificial Sequence
  Synthetic Construct
ggtaccaagcttgccaccatgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgatgagctagcgaattc

SEQ ID NO: 178 - DNA, 3816 bp, Artificial Sequence
  Synthetic Construct
ggtaccaagcttgccaccatgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgactgatgagctagcgaattc

SEQ ID NO: 179 - DNA, 3660 bp, Artificial Sequence
  Synthetic Construct
ggtaccaagcttgccaccatgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtgatgagctagcgaattc

SEQ ID NO: 180 - DNA, 2172 bp, Artificial Sequence
  Synthetic Construct
ggtaccaagcttgccaccatgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaatagccctggtggcagcggcggctatatccctgaagctcctagagatggccaggcctacgtgcggaaagatggcgaatgggtcctgctgagcaccttcctgtgatgagctagcgaattc

SEQ ID NO: 181 - DNA, 762 bp, Artificial Sequence
  Synthetic Construct
ggtaccaagcttgccaccatgttcgtgtttctggtgctgctgcctctggtgtccagccagtgtgtgaacatcaccaatctgtgccccttcggcgaggtgttcaacgccacaagattcgcctctgtgtacgcctggaaccggaagcggatcagcaattgcgtggccgactacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgattacaactacaagctgcccgacgacttcaccggctgtgtgattgcctggaacagcaacaacctggacagcaaagtcggcggcaactacaactacctgtaccggctgttccggaagtccaacctgaagcctttcgagcgggacatcagcaccgagatctatcaggccggcagcaccccttgcaatggcgtggaaggcttcaactgctacttcccactgcagtcctacggcttccagcctacaaacggcgtgggctaccagccttacagagtggtggtgctgagcttcgagctgctgcatgctcctgctacagtgtgtggtggcagcggcggctatattcccgaggctcctagagatggccaggcctacgttagaaaggacggcgagtgggtcctgctgagcaccttcctgtgatgagctagcgaattc

SEQ ID NO: 182 - DNA, 39 bp, Artificial Sequence
  Synthetic Construct
tctgagcccgtgctgaagggcgtgaaactgcactacaca

SEQ ID NO: 183 - DNA, 156 bp, Artificial Sequence
  Synthetic Construct
tacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgat

SEQ ID NO: 184 - DNA, 76 bp, Artificial Sequence
  Synthetic Construct
tatatccctgaagctcctagagatggccaggcctacgtgcggaaagatggcgaatgggtcctgctgagcaccttcc

SEQ ID NO: 185 - DNA, 12 bp, Artificial Sequence
  Synthetic Construct
ggcagcggcggc

SEQ ID NO: 186 - DNA, 15 bp, Artificial Sequence
  Synthetic Construct
ggtggcagcggcggc

SEQ ID NO: 187 - DNA, 12 bp, Artificial Sequence
  Synthetic Construct
agacgggccaga

SEQ ID NO: 188 - DNA, 12 bp, Artificial Sequence
  Synthetic Construct
ggtggcagcggc

SEQ ID NO: 189 - DNA, 51 bp, Artificial Sequence; identical to SEQ ID NO: 127
  Synthetic Construct

SEQ ID NO: 190 - DNA, 3750 bp, Artificial Sequence
  Synthetic Construct
ggtaccaagcttgccaccatgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaatagccctggcggcagcggatctgtggccagccagtctatcattgcctacacaatgagcctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgctcgggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgctcaggccctgaacaccctggtcaagcagctgtctagcaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcaaggcagcggcggctatattcccgaggctcctagagatggccaggcctacgttagaaaggacggcgagtgggtcctgctgagcaccttcctgtgatgagctagcgaattc

SEQ ID NO: 191 - DNA, 3660 bp, Artificial Sequence
  Synthetic Construct
ggtaccaagcttgccaccatgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtgatgagctagcgaattc

SEQ ID NO: 192 - DNA, 3750 bp, Artificial Sequence
  Synthetic Construct
ggtaccaagcttgccaccatgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaatagccctggcggcagcggatctgtggccagccagtctatcattgcctacacaatgagcctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgctcgggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgctcaggccctgaacaccctggtcaagcagctgtctagcaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcaaggcagcggcggctatattcccgaggctcctagagatggccaggcctacgttagaaaggacggcgagtgggtcctgctgagcaccttcctgtgatgagctagcgaattc

SEQ ID NO: 193 - DNA, 3714 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaatagccctggcggcagcggatctgtggccagccagtctatcattgcctacacaatgagcctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgctcgggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgctcaggccctgaacaccctggtcaagcagctgtctagcaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatacgtgcccgctcaagagaagaatttcaccaccgctccagccatctgccacgacggcaaagcccactttcctagagaaggcgtgttcgtgtccaacggcacccattggttcgtgacccagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggataagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcaaggcagcggcggctatattcccgaggctcctagagatggccaggcctacgttagaaaggacggcgagtgggtcctgctgagcaccttcctg

SEQ ID NO: 194 - DNA, 3624 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcag

SEQ ID NO: 195 - DNA, 3714 bp, Artificial Sequence
  Synthetic Construct
atgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaatagccctggcggcagcggatctgtggccagccagtctatcattgcctacacaatgagcctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgctcgggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgctcaggccctgaacaccctggtcaagcagctgtctagcaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcaaggcagcggcggctatattcccgaggctcctagagatggccaggcctacgttagaaaggacggcgagtgggtcctgctgagcaccttcctg

SEQ ID NO: 196 - DNA, 20 bp, 2019-nCoV
gaccccaaaatcagcgaaat

SEQ ID NO: 197 - DNA, 24 bp, 2019-nCoV
tctggttactgccagttgaatctg

SEQ ID NO: 198 - DNA, 24 bp, 2019-nCoV
accccgcattacgtttggtggacc

SEQ ID NO: 199 - DNA, 3855 bp, Artificial Sequence; identical to SEQ ID NO: 177
  Synthetic Construct

SEQ ID NO: 200 - DNA, 3816 bp, Artificial Sequence; identical to SEQ ID NO: 178
  Synthetic Construct

SEQ ID NO: 201 - DNA, 3660 bp, Artificial Sequence; identical to SEQ ID NO: 179
  Synthetic Construct

SEQ ID NO: 202 - DNA, 2172 bp, Artificial Sequence; identical to SEQ ID NO: 180
  Synthetic Construct

SEQ ID NO: 203 - DNA, 762 bp, Artificial Sequence; identical to SEQ ID NO: 181
  Synthetic Construct

SEQ ID NO: 204 - DNA, 3855 bp, Artificial Sequence
  Synthetic Construct
ggtaccaagcttgccaccatgttcgtgtttctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaatagccctggcggcagcggatctgtggccagccagtctatcattgcctacacaatgagcctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgctcgggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgctcaggccctgaacaccctggtcaagcagctgtctagcaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgatgagctagcgaattc

SEQ ID NO: 205 - protein, 1273 aa, Artificial Sequence
  COR200007
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSRAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 206 - protein, 1268 aa, Artificial Sequence
  COR200008
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSRAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGV

SEQ ID NO: 207 - protein, 1282 aa, Artificial Sequence
  COR200009
MDAMKRGLCCVLLLCGAVFVSAQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 208 - protein, 1282 aa, Artificial Sequence
  COR200010
MDAMKRGLCCVLLLCGAVFVSAQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSRAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 209 - protein, 1277 aa, Artificial Sequence
  COR200011
MDAMKRGLCCVLLLCGAVFVSAQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPSRAGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGV

SEQ ID NO: 210 - protein, 1304 aa, Artificial Sequence
  COR200018
MDAMKRGLCCVLLLCGAVFVSASQEIHARFRRFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 211 - DNA, 3819 bp, Artificial Sequence
  COR200007
atgttcgtgtttctggtactgctccccctcgtctccagtcaatgcgtgaacctgaccacaagaacccagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactatcacaagaacaacaagagctggatggaaagcgagttccgggtgtacagcagcgccaacaactgcacctttgaatacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaacctttctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagactggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagcagagccggatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactgggaaaatacgagcagtacatcaagtggccttggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacaca

SEQ ID NO: 212 - DNA, 3804 bp, Artificial Sequence
  COR200008
atgttcgtgtttctggtactgctccccctcgtctccagtcaatgcgtgaacctgaccacaagaacccagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactatcacaagaacaacaagagctggatggaaagcgagttccgggtgtacagcagcgccaacaactgcacctttgaatacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaacctttctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagactggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagcagagccggatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactgggaaaatacgagcagtacatcaagtggccttggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtg

SEQ ID NO: 213 - DNA, 3846 bp, Artificial Sequence
  COR200009
atggacgctatgaagaggggcctgtgctgtgtgctgctgctgtgcggagctgtgtttgtgtctgctcaatgcgtgaacctgaccacaagaacccagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactatcacaagaacaacaagagctggatggaaagcgagttccgggtgtacagcagcgccaacaactgcacctttgaatacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaacctttctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagactggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactgggaaaatacgagcagtacatcaagtggccttggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacaca

SEQ ID NO: 214 - DNA, 3846 bp, Artificial Sequence
  COR200010
atggacgctatgaagaggggcctgtgctgtgtgctgctgctgtgcggagctgtgtttgtgtctgctcaatgcgtgaacctgaccacaagaacccagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactatcacaagaacaacaagagctggatggaaagcgagttccgggtgtacagcagcgccaacaactgcacctttgaatacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaacctttctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagactggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagcagagccggatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactgggaaaatacgagcagtacatcaagtggccttggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacaca

SEQ ID NO: 215 - DNA, 3831 bp, Artificial Sequence
  COR200011
atggacgctatgaagaggggcctgtgctgtgtgctgctgctgtgcggagctgtgtttgtgtctgctcaatgcgtgaacctgaccacaagaacccagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactatcacaagaacaacaagagctggatggaaagcgagttccgggtgtacagcagcgccaacaactgcacctttgaatacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaacctttctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagactggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagcagagccggatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactgggaaaatacgagcagtacatcaagtggccttggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtg

SEQ ID NO: 216 - DNA, 3912 bp, Artificial Sequence
  COR200018
atggacgctatgaagaggggcctgtgctgtgtgctgctgctgtgcggagctgtgtttgtgtctgctagccaagagatccacgccagatttcggagattcgtgtttctggtgctgctgcctctggtgtccagccaatgcgtgaacctgaccacaagaacccagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactatcacaagaacaacaagagctggatggaaagcgagttccgggtgtacagcagcgccaacaactgcacctttgaatacgtgtcccagcctttcctgatggacctggaaggcaagcagggcaacttcaagaacctgcgcgagttcgtgttcaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaacctttctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagactggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggccagatctgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtggaagccgaggtgcagatcgacagactgatcaccggaaggctgcagtccctgcagacctacgttacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactgggaaaatacgagcagtacatcaagtggccttggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacaca

SEQ ID NO: 217 - DNA, 2846 bp, Artificial Sequence
  pShuttle_E1.CMVdel134TO
tcgcgcgtttcggtgatgacggtgaaaacctctgacacatgcagctcccggacgtcattgtcgatgctcttcagtccggtgtttatgtcacagatcagctgagcgatcgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccgcggccgggaacggtgcattggaagcttggtaccggtgaattcgctagcgttaacggatcctctagacgagatccgaacttgtttattgcagcttataatggttacaaataaagcaatagcatcacaaatttcacaaataaagcatttttttcactgcattctagttgtggtttgtccaaactcatcaatgtatcttatcatgtctgcgatcgcaggtaggtttgagtagtgggcgtggctaaggaagagcatcattgtcacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaagcccaatctgaataatgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgtttttccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcataacaccccttgtattactgtttatgtaagcagacagttttattgttcatgatgatatatttttatcttgtgcaatgtaacatcagagattttgagacacgggccagagctgca

SEQ ID NO: 218 - DNA, 30429 bp, Artificial Sequence
  ID_6598_ pAd26.dE1.dE3.5orf6
catcatcaataatataccccacaaagtaaacaaaagttaatatgcaaatgagcttttgaattttaacggttttggggcggagccaacgctgattggacgagaaacggtgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgagcgatcgcaggtaggtttgagtagtgggcgtggctaaggtgactataaaggcgggtgtcttacgagggtctttttgcttttctgcagacatcatgaacgggactggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcggtagtagcccctctgtgcccagttccatcatcgccgaggagaaactgctggccctgctggccgagctggaagccctgagccgccagctggccgccctgacccagcaggtgtccgagctccgcgaacagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgtgggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaaacggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcttgtctctgacttggaggttttcccggacgagctcgccgaggaggcggtccccgcccagcgagagaagctcttgcagggaagcaaagtttttcaggggcttgagcccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccgcgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagacggactcgggggcgaaggcgtccgctccgcagtgggcgcagacggtctcgcactcgactagccaggtgagctcgggctgctcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcagaccactctgagacgaaggcgcgcgtccacgccaagacaaaggaggccacgtgcgaggggtagcggtcgttgtccaccagggggtccaccttttccacggtatgcaggcacatgtccccctcctccgcatccaagaaggtgattggcttgtaggtgtaggccacgtgacctggggttcccgacgggggggtataaaagggggcgggtctgtgctcgtcctcactctcttccgcgtcgctgtccacgagcgccagctgttggggtaggtattccctctcaagagcgggcatgacctcggcactcaggttgtcagtttctagaaacgaggaggatttgatgtgggcctgccctgccgcgatgctttttaggagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatattcgcgcgcgacacacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcgtccaaggccatctgccactcgcgggcggccagcgctcgctcgtaggggttgaggggcggaccccaaggcatgggatgcgtgagggcggaggcgtacatgccgcagatgtcatagacatagatgggctccgagaggatgccgatgtaggtgggatagcagcgccccccgcggatgcttgcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtgaggcaggcggaccgagtcgcggatgaagtgcgcgtaggagtcttgcagcttggcgacgagctcggcggtgacgaggacgtccatggcgcagtagtccagcgtttcgcggatgatgtcataactcgcctctcctttcttctcccacagctcgcggttgagggcgtattcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcaaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcaaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaaacgcacggcgagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatttctacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggacatgaactgttcgatctcctcctcctggagatcgccgcggcccgcgcgctccacggtggcggcgaggtcattggagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcaaagacggcgtagttgcgcaggcgctggaagaggtagttgagggtggtggcgatgtgctcggtgacgaagaagtacatgatccagcggcgcaggggcatctcgctgatgtcgccgatggcttccagcctttccatggcctcgtagaagtccacggcgaagttgaaaaactgggcgttgcgggccgagaccgtgagctcgtcttccaggagccggatgagttcggcgatggtggcgcgcacctcgcgctcgaaatccccgggggcctcctcctcttcctcttcttccatgacgacctcttcttctatttcttcctctgggggcggtggtggtggcgggggccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccattgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgcggacgctgttagaattgcggttgctgatgatgtaattgaagtaggcgtttttgaggcggcggatggtggcgaggaggaccaggtccttgggtccagcttgctggatgcggagccgctcggccatgccccaggcctggccctgacaccggctcaggttcttgtagtagtcatgcatgagcctctcaatgtcatcactggctgaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtgataggccccggtgttgatggtgtaggtgcagttggccatgagcgaccagttgacggtctgcaggcctggctgcacgacctcggagtacctgagccgcgagaaggcgcgcgagtcgaagacgtagtcgttgcaggtgcgcacgaggtactggtatccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgagtggggtcgctagacttgaaagcgaccgaaaaccctgccgggtagtggctcgcgcccgtagtctggagaagcatcgccagggttgagtcgcggcagaacccggttcgaggacggccgcggcgagcgggacttggtcaccccgccgatataaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccaccacagacagagatggacttggaagagggcgaagggctggcaagactgggggcgccgtccccggagcgacatccccgcgtgcagctgcagaaggacgtgcgcccggcgtacgtgcctacgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcacgcgcgcacgtggcggcagccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagtctgcgccgggcgctggtagggggcgccgccggcggcgaggagtcctacttcgacatgggtgcggacctgcattggcagccgagccggcgcgccttggaggccgcctacggttcagaggacttggatgaggaagaggaagaggaggaggatgcacccgctgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaatctgcgcgggctgtggggcgtgcaggcgcccgtgggcgaccggtcaacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaactttttgctgaccaatagacagcagaagatcccggcgcagtacgcactgtcggccgaggaggaaaggattctgagatatgtgcagcagagcgtagggctgttcctgatgcaggagggtgccacccccagcgccgcgctggacatgaccgcgcgcaacatggaacctagcatgtacgccgccaaccggccgttcatcaataagctgatggactacttgcaccgcgcggcggccatgaacacggactactttaccaacgccatcctgaacccgcactggctcccgccgccggggttctacacgggcgagtacgacatgcccgaccccaacgacgggttcctgtgggacgacgtggacagcgcggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaatgaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtgtctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcagaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggccacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcatacaagcgcgggcggacttccaccgccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccattggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttgagggaaaagctcaaagaccagaacttccagcagaaggtggtggacgggctggcctcgggcattaacggggtggtggacatcgcgaaccaggccgtgcagcgcgagataaacagccgcctggacccgcgaccgcccacggtggtggagatggaagatgcaactcttccgccgcccaagggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcctacaacagcctggctcccaagggtgcccccaatcccagtcagtgggaaacaaaagaaaagcaaggaactactggaggagtgcagcaagaaaaagatgtcacaaaaacatttggtgtggctgccaccggcggaattaatataacaaaccagggtctgttactaggaactgacgaaaccgctgagaatggcaaaaaagacatttatgcagacaagactttccagccagaacctcaagttggagaagaaaactggcaggaaaatgaagccttctatggaggaagggctcttaaaaaggacactaaaatgaaaccatgctatggatcttttgctagacctactaatgagaaaggaggtcaggcaaagttcaaaccagttaatgaaggagaacaacctaaagatctggatatagattttgcttactttgacgtccctggcggaagtcctccagcaggtggtagtggggaagaatacaaagcagatataattttgtacactgaaaatgttaatcttgaaacaccagacactcatgtggtttacaagccaggaacttcagataacagttcagaaatcaatctggttcagcagtccatgccaaacagacccaactacattggctttagggacaactttgtaggtctcatgtattacaacagcaccggaaatatgggtgtgctggctggtcaggcttctcagttgaacgctgtggtcgacttgcaagacagaaacaccgagttatcttaccagctattgctagattctctgggtgacagaaccagatactttagcatgtggaactctgcggtggacagttacgatccagatgtcaggatcattgaaaatcacggtgtggaagatgaacttccaaactattgcttcccattgaatggcactggaaccaattccacttatcaaggtgtaaagattacaaatggtaatgatggtgctgaagaaagtgagtgggagaaagacgatgcaatttctagacaaaaccaaatctgcaagggcaatgtctacgccatggagatcaacctgcaggccaacctgtggaagagttttctgtactcgaacgtggccctgtacctgcccgactcctacaagtacacgccggccaacgtcaagctgcccgccaacaccaacacctacgagtacatgaacggccgcgtggtagccccctcgctggtggacgcctacatcaacatcggcgcccgctggtcgttggaccccatggacaacgtcaaccccttcaaccaccaccgcaatgcgggcctgcgctaccgctccatgctgctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggcaacgacctgcgcgtcgacggcgcctccgtccgcttcgacagcgtcaacctatacgccactttcttccccatggcgcacaacaccgcttcaaccttggaagccatgctgcgcaacgacaccaacgaccagtccttcaacgactacctctcggccgccaacatgctctaccccatcccggccaaggccaccaacgtgcccatctccatcccatcgcgcaactgggccgccttccgcggctggagtttcacccggctcaagaccaaggaaactccttccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaataactcgggcttcaccggctacctcgcacccaccatgcgccaggggcagccctaccccgccaacttcccctacccgctcatcggtcagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtacaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggctttctcgccggcgacaagctggcctgcgccatcgtcaacacggccggccgcgagaccggaggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgaccgctgtctcagcctcgagcagtccactcagaccgtgcaggggcccgactccgccgcctgcggactcttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggaactctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggcactggggtctcggggaaggtctcgctccacatgcgccggctcatctgcagggcgcccagcatgtccggggcggagatcttgaaatcgcagttggggccggtgctctgcgcgcgcgagttgcggtacacggggttgcagcactggaacaccatcagactggggtacttcacactagccagcacgctcttgtcgctgatctgatccttgtccagatcctcggcgttgctcaggccgaacggggtcatcttgcacagctggcgtcccaggaagggcacgctctgaggcttgtggttacactcgcagtgcacgggcatcagcatcatccccgcgccgcgctgcatattcgggtagagggccttgacaaaggccgcgatctgcttgaaagcttgctgggccttggccccctcgctgaaaaacaggccgcagctcttcccgctgaactggttattcccacacccggcatcctgcacgcagcagcgcgcgtcatggctggtcagttgcaccacgctccgtccccagcggttctgggtcaccttagccttgctgggctgctccttcaacgcgcgctgcccgttctcgctggtcacatccatctccaccacgtggtccttgtggatcatcatcgtcccgtgcagacacttgagctggccttccacctcggtgcagccgtgatcccacagggcgcaaccggtgcactcccagttcttgtgcgcaatcccgctgtggctgaagatgtaaccttgcaacatgcggcccatgatggtgctaaatgctttctgggtggtgaaggtcagttgcatcccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagagggttgcgtacgttcaggacaccgggggtcgcgggctcgacgatgcgttttccgtccttgccttccttcaatagaaccggcggctggctgaatcccactcccacgatcacggcatcttcctggggcatctcttcgtcggggtctaccttggtcacatgcttggtctttctggcttgcttcttttttggagggctgtccacggggagcacgtcctcctcggaagacccggagcccacccgctgatactttcggcgcttggtgggcagaggaggtggcggcgaggggctcctctcctgctccggcggatagcgcgccgacccgtggccccggggcggagtggcctctcggcccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcgccgcgcgtaccccccaaacgccagcccaacggcacctgcgagcccaacccgcgtctcaacttctatcccgtctttgcggtccccgaagccctcgccacctatcacatctttttcaagaaccaaaagatccccgtctcctgccgcgccaaccgcaccagcgccgacgcgctcctcgctttggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagcttacccacttcgcctaccccgccgtcaacctcccgcccaaggtcatgcgtcgcatcatggatcagctcatcatgccccacatcgaggccctcgatgaaagtcaggagcagcgccccgaggacgcccggcccgtggtcagcgacgagatgctcgcgcgctggctcgggacccgcgacccccaggctttggaacagcggcgcaaactcatgctggccgtggtcctggtcacccttgagctcgaatgcatgcgccgctttttcagcgaccccgagaccctgcgcaaggtcgaggagaccctgcactacactttcaggcacggtttcgtcaggcaggcctgcaagatctccaacgtggagctgaccaacctggtctcctgcctggggatcctgcacgagaaccgcctgggccagaccgtgctccactctaccctgaagggcgaggcgcggcgggactatgtccgcgactgcgtctttctctttctctgccacacatggcaagcggccatgggcgtgtggcagcagtgtctcgaggacgagaacctaaaggagctggacaagcttcttgctagaaaccttaaaaagctgtggacgggcttcgacgagcgcaccgtcgcctcggacctggccgagatcgtcttccccgagcgcctgagacagacgctgaaaggcgggctgcccgacttcatgagccagagcatgttgcaaaactaccgcactttcattcttgagcgatcaggcatcctgcccgccacctgcaacgccttcccctccgactttgtaccgctgagctaccgcgagtgtcccccgccgctgtggagccactgctacctcttgcagctggccaactacatcgcctaccactcggacgtgatcgaggacgtgagcggcgaggggctgctcgagtgccactgtcgctgcaacctgtgctccccgcatcgctccctggtctgcaacccccagctcctgagcgagacccaggtcatcggtaccttcgagctgcaaggtccgcaggagtccaccgctccgctgaaactcacgccggggttgtggacttccgcgtacctgcgcaaatttgtacccgaagactaccacgcccatgagataaagttctttgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccgccggtcacggatacaacctccgctccggtcaagcctcctcgtagatgggatcaagtgaagggtgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagtttgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtccaaccccgaagttgcatgagaatttttgttgtactctttgtggtgagtttaataaaagctaaactcttgcaatactctggaccttgtcgtcgtcaactcaacgagaccgtctacctcaccaaccagactgaggtaaaactcacctgcagaccacacaagacctatatcatctggttcttcgagaacacctcatttgcagtctccaacactcactgcactagtccatgaactgatgttgattaaaagcccaaaaaccaatcagccccttcccccatttccccatcccccaattactcataaaaaataaatcattggaattaatcattcaataaagatcacttacttgaaatctgaaagtatgtctctggtgtagttgttcagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcacttaaactggctgatccaatcaccatcaacaatggggatgtctcacttaaggtgggagggggacttgctgtagagcaacagactggtaacctaagcgtaaaccctgatgcacccttgcaagttgcaagtgataagctacagcttgctctggctcctccattcgaggtcagagatggaaagcttgctttaaaggcaggtaatggattaaaagtactagataattccattactggattgactggattattgaatacacttgtggtattaactggaaggggaataggaacggaggaattaaaaaatgacgatggtgtaacaaacaaaggagtcggcttgcgtgtaagacttggagatgacggcgggctgacatttgataaaaagggtgatttagtagcctggaataaaaaagatgacaggcgcaccctgtggacaacccctgacacatctccaaattgcaaaatgagtacagaaaaggattctaaacttacgttgacacttacaaagtgtggaagtcaggttctgggaaatgtatctttacttgcagttacaggtgaatatcatcaaatgactgctactacaaagaaggatgtaaaaatatctttactatttgatgagaatggaattctattaccatcttcgtcccttagcaaagattattggaattacagaagtgatgattctattgtatctcaaaaatataataatgcagttccattcatgccaaacctgacagcttatccaaaaccaagcgctcaaaatgcaaaaaactattcaagaactaaaatcataagtaatgtctacttaggtgctcttacctaccaacctgtaattatcactattgcatttaatcaggaaactgaaaatggatgtgcttattctataacatttaccttcacttggcaaaaagactattctgcccaacagtttgatgttacatcttttaccttctcatatcttacccaagagaacaaagacaaagactaataaaatgttttgaactgaatttatgaatctttatttatttttacaccagcacgggtagtcagtttcccaccaccagcccatttcacagtgtaaacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcattgaaatggattctcttgcgtaccttgtcgtacttctgccagcagaaagtggctcgggaacagcagatacctttcctcctgctgtccttccgctgctgacgctcagtcatccaactgaagtacagccattcccgcaggttctccagcagctcctgtgcatctgatgaaacaaaagtcccgtcgatgcggattccccttaaaacatcagccaggacattgtaggccatcccaatccagttaatgcatcctgatctatcatgaagaggaggtgggggaagaactggaagaaccatttttattccaagcggtctcgaaggacgataaagtgcaagtcacgcaggtgacagcgttccccgccgctgtgctggtggaaacagacagccaggtcaaaacccactctattttcaaggtgctcgactgtggcttcgagcagtggctctacgcgtacatccagcataagaatcacattaaaggctggacctccatcgatttcatcaatcatcaggttacactcattcaccatccccaggtaattctcatttttccagccttggattatttctacaaattgttggtgtaagtccactccgcacatgtggaaaagttcccacagcgccccctccactttcataatcaggcagaccttcatattagaaacagatcctgctgctccaccacctgcagcgtgttcaaaacaacaagattcaatgaggttctgccctctgccctcagctcacgtctcagcgtcagctgcaaaaagtcactcaagtcctcagccactacagctgacaattcagagccagggctaagcgtgggactggcaagcgtgagtgagtactttaatgctccaaagctagcacccaaaaactgcatgctggaataagctctctttgtgtcaccggtgatgccttccaataggtgagtgataaagcgaggtagtttttctttaatcatttgagtaatagaaaagtcctctaaataagtcactaggaccccaggaaccacaatgtggtagctgacagcgtgtcgctcaagcatggttagtagagatgagagtctgaaaaacagaaagcatgcactaaaccagagttgccagtctcactgaaggaaaaatcactctctccagcagcaaagtgcccactgggtggccctctcggacatacaaaaatcgatccgtgtggttaaagagcagcacagttagctcctgtcttctcccagcaaagatcacatcggactgggttagtatgcccctggaatggtagtcattcaaggccataaatctgccttggtagccattaggaatcagcacgctcactctcaagtgaaccaaaaccaccccatgcggaggaatgtggaaagattctgggcaaaaaaaggtatatctattgctagtcccttcctggacgggagcaatccctccagggctatctatgaaagcatacagagattcagccatagctcagcccgcttaccagtagacagagagcacagcagtacaagcgccaacagcagcgactgactacccactgacccagctccctatttaaaggcaccttacactgacgtaatgaccaaaggtctaaaaaccccgccaaaaaaacacacacgccctgggtgtttttcgcgaaaacacttccgcgttctcacttcctcgtatcgatttcgtgactcaacttccgggttcccacgttacgtcacttctgcccttacatgtaactcagccgtagggcgccatcttgcccacgtccaaaatggcttccatgtccggccacgcctccgcggcgaccgttagccgtgcgtcgtgacgtcatttgcatcaccgtttctcgtccaatcagcgttggctccgccccaaaaccgttaaaattcaaaagctcatttgcatattaacttttgtttactttgtggggtatattattgatgatgatttaaatattatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattgatttaaat

SEQ ID NO: 219 - DNA, 750 bp, Artificial Sequence
  CMVdel134 including 2x TO
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccgcggccgggaacggtgcattggaa

SEQ ID NO: 220 - DNA, 33 bp, Artificial Sequence
  an overlap with the shuttle vector, an HindIII restriction site and a Kozak sequence
cggccgggaacggtgcattggaagcttgccacc

SEQ ID NO: 221 - DNA, 34 bp, Artificial Sequence
  double stop codon, XbaI restriction site and overlap sequence with the shuttle expression vector
tgataatctagacgagatccgaacttgtttattg

SEQ ID NO: 222 - DNA, 37 bp, Artificial Sequence
  primer 7_fw
gctccccctcgtctccagtcaatgcgtgaacctgacc

SEQ ID NO: 223 - DNA, 38 bp, Artificial Sequence
  primer 8_Rv
agtaccagaaacacgaacatggtggcaagcttccaatg

SEQ ID NO: 224 - protein, 4 aa, Artificial Sequence
  wild type Furin cleavage site
RRAR

SEQ ID NO: 225 - protein, 4 aa, Artificial Sequence
  dFur
SRAG

SEQ ID NO: 226 - protein, 5 aa, Artificial Sequence
  ER retention signal
KLHYT

The invention claimed is:

1. An isolated nucleic acid encoding a polypeptide comprising a modified coronavirus Spike (S) protein, wherein the polypeptide comprises amino acids residues 14-1273 of SEQ ID NO: 205.

2. The isolated nucleic acid according to claim 1, wherein the polypeptide comprises the amino sequence of SEQ ID NO: 205.

3. The isolated nucleic acid according to claim 1, wherein the polypeptide comprises the amino sequence of SEQ ID NO: 208.

4. The isolated nucleic acid according to claim 1, wherein the isolated nucleic acid comprises a nucleotide sequence at least 90% identical to SEQ ID NO:211, or SEQ ID NO: 214.

5. A vector comprising the nucleic acid according to claim 1.

6. The vector according to claim 5, wherein the vector is a recombinant adenovirus vector.

7. The vector according to claim 6, wherein the recombinant adenovirus vector has a deletion in the E1 region, a deletion in the E3 region, or a deletion in both the E1 region and the E3 region of the adenoviral genome.

8. The vector according to claim 5, wherein the nucleic acid encoding the polypeptide comprising the modified coronavirus S protein is operably linked to a cytomegalovirus (CMV) promoter comprising at least one tetracycline operator (TetO) motif.

9. The vector of claim 8, wherein the nucleic acid encoding the polypeptide comprising the modified coronavirus S protein is operably linked to the CMV promoter having the nucleotide sequence of SEQ ID NO: 219.

10. A recombinant human adenovirus vector of serotype 26 comprising a nucleic acid encoding a polypeptide comprising a modified coronavirus Spike (S) protein, wherein the recombinant human adenovirus has a deletion in the E1 region, a deletion in the E3 region, or a deletion in both the E1 and the E3 region of the adenoviral genome, the nucleic acid encoding the polypeptide comprising the modified coronavirus S protein is operably linked to a cytomegalovirus (CMV) promoter comprising the nucleotide sequence of SEQ ID NO: 219, and the polypeptide comprises amino acids residues 14-1273 of SEQ ID NO: 205.

11. The recombinant human adenovirus vector of serotype 26 according to claim 10, wherein the polypeptide comprises the amino sequence of SEQ ID NO: 205.

12. The recombinant human adenovirus vector of serotype 26 according to claim 10, wherein the polypeptide comprises the amino sequence of SEQ ID NO: 208.

13. The recombinant human adenovirus vector of serotype 26 according to claim 10, wherein the isolated nucleic acid comprises the nucleotide sequence of SEQ ID NO:211.

14. The recombinant human adenovirus vector of serotype 26 according to claim 10, wherein the isolated nucleic acid comprises the nucleotide sequence of SEQ ID NO:214.

15. A recombinant vector comprising the polynucleotide sequence of SEQ ID NO: 218 and the polynucleotide sequence of SEQ ID NO: 211 or SEQ ID NO: 214.

16. A pharmaceutical composition comprising the nucleic acid according to claim 1 and a pharmaceutically acceptable carrier.

17. A pharmaceutical composition comprising the vector according to claim 5 and a pharmaceutically acceptable carrier.

18. A pharmaceutical composition comprising the vector according to claim 10 and a pharmaceutically acceptable carrier.

19. A pharmaceutical composition comprising the vector according to claim 15 and a pharmaceutically acceptable carrier.

20. An isolated host cell comprising the nucleic acid according to claim 1.

21. An isolated host cell comprising the vector according to claim 5.

22. An isolated host cell comprising the vector according to claim 15.

23. A method of producing the vector of claim 5, comprising growing a host cell comprising the vector under conditions for the production of the vector.

24. A method of manufacturing a pharmaceutical composition, the method comprising:
(a) admixing the nucleic acid of claim 1 or a vector comprising the nucleic acid of claim 1 with a pharmaceutically acceptable carrier to form the pharmaceutical composition; and
(b) placing the pharmaceutical composition in a container.

25. A method of inducing an immune response in a subject in need thereof, comprising administering to the subject the pharmaceutical composition of claim 16.

26. A method of inducing an immune response in a subject in need thereof, comprising administering to the subject the pharmaceutical composition of claim 17.

27. A method of inducing an immune response in a subject in need thereof, comprising administering to the subject the pharmaceutical composition of claim 19.

28. A method for active immunization to prevent coronavirus disease 2019 (COVID-19) caused by severe acute respiratory syndrome coronavirus 2 (SARS-CoV-2) in a subject 18 years of age and older, the method comprising administering to the subject the pharmaceutical composition according to claim 16.

29. A method for active immunization to prevent coronavirus disease 2019 (COVID-19) caused by severe acute respiratory syndrome coronavirus 2 (SARS-CoV-2) in a subject 18 years of age and older, the method comprising administering to the subject the pharmaceutical composition according to claim 17.

30. A method for active immunization to prevent coronavirus disease 2019 (COVID-19) caused by severe acute respiratory syndrome coronavirus 2 (SARS-CoV-2) in a subject 18 years of age and older, the method comprising administering to the subject the pharmaceutical composition according to claim 19.

* * * * *